United States Patent 11,685,924 (GENETIC ELEMENTS DRIVING CIRCULAR RNA TRANSLATION AND METHODS OF USE) - sequence listing, part 3

SEQ ID NO: 24836 - DNA, 20 bp, synthetic construct
  source 1..20: mol_type = other DNA
gacgtaaagatgaccgaaga

SEQ ID NO: 24837 - DNA, 20 bp, synthetic construct
  source 1..20: mol_type = other DNA
tgggccctccagggaaaacg

SEQ ID NO: 24838 - DNA, 20 bp, synthetic construct
  source 1..20: mol_type = other DNA
tgggatgtggattactcggc

SEQ ID NO: 24839 - DNA, 20 bp, synthetic construct
  source 1..20: mol_type = other DNA
cgcccttctagggcctacga

SEQ ID NO: 24840 - DNA, 20 bp, synthetic construct
  source 1..20: mol_type = other DNA
atccttcacaggttcagaca

SEQ ID NO: 24841 - DNA, 20 bp, synthetic construct
  source 1..20: mol_type = other DNA
ctgtcacctgaaaataagac

SEQ ID NO: 24842 - DNA, 20 bp, synthetic construct
  source 1..20: mol_type = other DNA
gtcatgaccctggctgattt

SEQ ID NO: 24843 - DNA, 20 bp, synthetic construct
  source 1..20: mol_type = other DNA
acaacgcacattttggaact

SEQ ID NO: 24844 - DNA, 20 bp, synthetic construct
  source 1..20: mol_type = other DNA
agagagaaataccaactcac

SEQ ID NO: 24845 - DNA, 20 bp, synthetic construct
  source 1..20: mol_type = other DNA
attggctcactaaaagctga

SEQ ID NO: 24846 - DNA, 20 bp, synthetic construct
  source 1..20: mol_type = other DNA
tgggatactgggttgaactc

SEQ ID NO: 24847 - DNA, 20 bp, synthetic construct
  source 1..20: mol_type = other DNA
gggaaaaccatggaaaacaa

SEQ ID NO: 24848 - DNA, 20 bp, synthetic construct
  source 1..20: mol_type = other DNA
atcgccagtgagacccacat

SEQ ID NO: 24849 - DNA, 20 bp, synthetic construct
  source 1..20: mol_type = other DNA
tccgcatttgaggaattgac

SEQ ID NO: 24850 - DNA, 20 bp, synthetic construct
  source 1..20: mol_type = other DNA
caactcaaggcacgtgacat

SEQ ID NO: 24851 - DNA, 20 bp, synthetic construct
  source 1..20: mol_type = other DNA
aagagcttccttgctaatgt

SEQ ID NO: 24852 - DNA, 20 bp, synthetic construct
  source 1..20: mol_type = other DNA
gtacatgacagcattaaaga

SEQ ID NO: 24853 - DNA, 20 bp, synthetic construct
  source 1..20: mol_type = other DNA
gcggagaaaccacaagctga

SEQ ID NO: 24854 - DNA, 20 bp, synthetic construct
  source 1..20: mol_type = other DNA
ggaccagtgaagaagcctgt

SEQ ID NO: 24855 - DNA, 20 bp, synthetic construct
  source 1..20: mol_type = other DNA
acggcttacctcgtgcctcg

SEQ ID NO: 24856 - DNA, 20 bp, synthetic construct
  source 1..20: mol_type = other DNA
gaggggttggtagtggacac

SEQ ID NO: 24857 - DNA, 20 bp, synthetic construct
  source 1..20: mol_type = other DNA
tccaaacacaagggcgatgc

SEQ ID NO: 24858 - DNA, 20 bp, synthetic construct
  source 1..20: mol_type = other DNA
cagtacaaaaacgtttggga

SEQ ID NO: 24859 - DNA, 20 bp, synthetic construct
  source 1..20: mol_type = other DNA
ttggactttgaagctctcaa

SEQ ID NO: 24860 - DNA, 20 bp, synthetic construct
  source 1..20: mol_type = other DNA
cccttttagggcccacgacc

SEQ ID NO: 24861 - DNA, 20 bp, synthetic construct
  source 1..20: mol_type = other DNA
agcacatgagcggtgggaac

SEQ ID NO: 24862 - DNA, 20 bp, synthetic construct
  source 1..20: mol_type = other DNA
caccatgactctggccgatt

SEQ ID NO: 24863 - DNA, 20 bp, synthetic construct
  source 1..20: mol_type = other DNA
ggacgtagattggcaggacc

SEQ ID NO: 24864 - DNA, 20 bp, synthetic construct
  source 1..20: mol_type = other DNA
ccacaacacaactacatcca

SEQ ID NO: 24865 - DNA, 20 bp, synthetic construct
  source 1..20: mol_type = other DNA
gcgtgacgtttcacaactca

SEQ ID NO: 24866 - DNA, 20 bp, synthetic construct
  source 1..20: mol_type = other DNA
gggacaggacaacgtcgagg

SEQ ID NO: 24867 - DNA, 20 bp, synthetic construct
  source 1..20: mol_type = other DNA
accgcgcacagcgtttcccg

SEQ ID NO: 24868 - DNA, 20 bp, synthetic construct
  source 1..20: mol_type = other DNA
tggcgctgatcttgaatttc

SEQ ID NO: 24869 - DNA, 20 bp, synthetic construct
  source 1..20: mol_type = other DNA
tacgatcaccgcctcaaaga

SEQ ID NO: 24870 - DNA, 20 bp, synthetic construct
  source 1..20: mol_type = other DNA
ggacaacccagttgttcacg

SEQ ID NO: 24871 - DNA, 20 bp, synthetic construct
  source 1..20: mol_type = other DNA
aatcacaagatgcaggccca

SEQ ID NO: 24872 - DNA, 20 bp, synthetic construct
  source 1..20: mol_type = other DNA
cagcaccttcgtcgtgaaga

SEQ ID NO: 24873 - DNA, 20 bp, synthetic construct
  source 1..20: mol_type = other DNA
ggtctccaccacagggttca

SEQ ID NO: 24874 - DNA, 20 bp, synthetic construct
  source 1..20: mol_type = other DNA
tccctgggccctccagggga

SEQ ID NO: 24875 - DNA, 20 bp, synthetic construct
  source 1..20: mol_type = other DNA
aggtggaatgccctcgggtt

SEQ ID NO: 24876 - DNA, 20 bp, synthetic construct
  source 1..20: mol_type = other DNA
tgttgattcttggattgaat

SEQ ID NO: 24877 - DNA, 20 bp, synthetic construct
  source 1..20: mol_type = other DNA
cggaggaactgattgaaatg

SEQ ID NO: 24878 - DNA, 20 bp, synthetic construct
  source 1..20: mol_type = other DNA
atcttccaatcacaggctcc

SEQ ID NO: 24879 - DNA, 20 bp, synthetic construct
  source 1..20: mol_type = other DNA
gatccgtatattttaaagaa

SEQ ID NO: 24880 - DNA, 20 bp, synthetic construct
  source 1..20: mol_type = other DNA
tggttacattttgttaatta

SEQ ID NO: 24881 - DNA, 20 bp, synthetic construct
  source 1..20: mol_type = other DNA
ctaattggaaatgctacggt

SEQ ID NO: 24882 - DNA, 20 bp, synthetic construct
  source 1..20: mol_type = other DNA
aacatttaccgtatattcag

SEQ ID NO: 24883 - DNA, 20 bp, synthetic construct
  source 1..20: mol_type = other DNA
caattttttcaactaaaaag

SEQ ID NO: 24884 - DNA, 20 bp, synthetic construct
  source 1..20: mol_type = other DNA
accaccaaacatgacaccag

SEQ ID NO: 24885 - DNA, 20 bp, synthetic construct
  source 1..20: mol_type = other DNA
atcaatacacatatactcgt

SEQ ID NO: 24886 - DNA, 20 bp, synthetic construct
  source 1..20: mol_type = other DNA
cacaagcatttcgtaacgtg

SEQ ID NO: 24887 - DNA, 20 bp, synthetic construct
  source 1..20: mol_type = other DNA
ggacggatgtatcaacacaa

SEQ ID NO: 24888 - DNA, 20 bp, synthetic construct
  source 1..20: mol_type = other DNA
agcatttaatcttttaagat

SEQ ID NO: 24889 - DNA, 20 bp, synthetic construct
  source 1..20: mol_type = other DNA
atgcctacttgacctcccac

SEQ ID NO: 24890 - DNA, 20 bp, synthetic construct
  source 1..20: mol_type = other DNA
ggactgcggtgcatgtgact

SEQ ID NO: 24891 - DNA, 20 bp, synthetic construct
  source 1..20: mol_type = other DNA
agttgacaagacacatggct

SEQ ID NO: 24892 - DNA, 20 bp, synthetic construct
  source 1..20: mol_type = other DNA
acgaacaacaccggctcttc

SEQ ID NO: 24893 - DNA, 20 bp, synthetic construct
  source 1..20: mol_type = other DNA
cttcccttgcagggaaaatg

SEQ ID NO: 24894 - DNA, 20 bp, synthetic construct
  source 1..20: mol_type = other DNA
atggtcctgtctcctcttct

SEQ ID NO: 24895 - DNA, 20 bp, synthetic construct
  source 1..20: mol_type = other DNA
ttgagggcgccggcaaactt

SEQ ID NO: 24896 - DNA, 20 bp, synthetic construct
  source 1..20: mol_type = other DNA
ctgtccctctccccaatcca

SEQ ID NO: 24897 - DNA, 20 bp, synthetic construct
  source 1..20: mol_type = other DNA
tgattgaacctgtccttctt

SEQ ID NO: 24898 - DNA, 20 bp, synthetic construct
  source 1..20: mol_type = other DNA
ccggaccatcatccgctccc

SEQ ID NO: 24899 - DNA, 20 bp, synthetic construct
  source 1..20: mol_type = other DNA
aacctcgtaccaccttctcc

SEQ ID NO: 24900 - DNA, 20 bp, synthetic construct
  source 1..20: mol_type = other DNA
tgactaacgatgtccccacc

SEQ ID NO: 24901 - DNA, 20 bp, synthetic construct
  source 1..20: mol_type = other DNA
cccttctgtctggttgtgcc

SEQ ID NO: 24902 - DNA, 20 bp, synthetic construct
  source 1..20: mol_type = other DNA
atatctcaatggcagcaaac

SEQ ID NO: 24903 - DNA, 20 bp, synthetic construct
  source 1..20: mol_type = other DNA
ctttctccaaaaccttcact

SEQ ID NO: 24904 - DNA, 20 bp, synthetic construct
  source 1..20: mol_type = other DNA
tcacgcgctgtcgcgagctc

SEQ ID NO: 24905 - DNA, 20 bp, synthetic construct
  source 1..20: mol_type = other DNA
ctggcaagtccctccttgct

SEQ ID NO: 24906 - DNA, 20 bp, synthetic construct
  source 1..20: mol_type = other DNA
gccaacatcgcgatctccgt

SEQ ID NO: 24907 - DNA, 20 bp, synthetic construct
  source 1..20: mol_type = other DNA
ccttccagggtctctgtggt

SEQ ID NO: 24908 - DNA, 20 bp, synthetic construct
  source 1..20: mol_type = other DNA
ccatccacgctatcatcgct

SEQ ID NO: 24909 - DNA, 20 bp, synthetic construct
  source 1..20: mol_type = other DNA
ttgatgccaccctcccttcc

SEQ ID NO: 24910 - DNA, 20 bp, synthetic construct
  source 1..20: mol_type = other DNA
ttgttgtgactccagcaaac

SEQ ID NO: 24911 - DNA, 20 bp, synthetic construct
  source 1..20: mol_type = other DNA
gtgaacaagtgccacgtaca

SEQ ID NO: 24912 - DNA, 20 bp, synthetic construct
  source 1..20: mol_type = other DNA
gacaagccaacagtcgacat

SEQ ID NO: 24913 - DNA, 20 bp, synthetic construct
  source 1..20: mol_type = other DNA
cagatttttggagcagcctt

SEQ ID NO: 24914 - DNA, 20 bp, synthetic construct
  source 1..20: mol_type = other DNA
tccgtttcaagaatggaaaa

SEQ ID NO: 24915 - DNA, 20 bp, synthetic construct
  source 1..20: mol_type = other DNA
tgcggaactagaggaccatc

SEQ ID NO: 24916 - DNA, 20 bp, synthetic construct
  source 1..20: mol_type = other DNA
ccccctagtgaagttctcac

SEQ ID NO: 24917 - DNA, 20 bp, synthetic construct
  source 1..20: mol_type = other DNA
tgggaaaaggacgcggaagt

SEQ ID NO: 24918 - DNA, 20 bp, synthetic construct
  source 1..20: mol_type = other DNA
agggccagaaacattcagac

SEQ ID NO: 24919 - DNA, 20 bp, synthetic construct
  source 1..20: mol_type = other DNA
gaagtggaagtcccagagag

SEQ ID NO: 24920 - DNA, 20 bp, synthetic construct
  source 1..20: mol_type = other DNA
tttcagaaaacaaaaaatca

SEQ ID NO: 24921 - DNA, 20 bp, synthetic construct
  source 1..20: mol_type = other DNA
gctgctcagaggagaggacg

SEQ ID NO: 24922 - DNA, 20 bp, synthetic construct
  source 1..20: mol_type = other DNA
ctgggaacactgccaggaca

SEQ ID NO: 24923 - DNA, 20 bp, synthetic construct
  source 1..20: mol_type = other DNA
caaagatctccccaagataa

SEQ ID NO: 24924 - DNA, 20 bp, synthetic construct
  source 1..20: mol_type = other DNA
ggagtcccgctgctaatgat

SEQ ID NO: 24925 - DNA, 20 bp, synthetic construct
  source 1..20: mol_type = other DNA
gaaggctctccaaacaaata

SEQ ID NO: 24926 - DNA, 20 bp, synthetic construct
  source 1..20: mol_type = other DNA
cgtctgaatcagatgtcggc

SEQ ID NO: 24927 - DNA, 20 bp, synthetic construct
  source 1..20: mol_type = other DNA
ccctatgggaaggttgttga

SEQ ID NO: 24928 - DNA, 20 bp, synthetic construct
  source 1..20: mol_type = other DNA
gacgtcttccacatggcggc

SEQ ID NO: 24929 - DNA, 20 bp, synthetic construct
  source 1..20: mol_type = other DNA
agcactatgatggaaaccat

SEQ ID NO: 24930 - DNA, 20 bp, synthetic construct
  source 1..20: mol_type = other DNA
agggtgccagatccccaaga

SEQ ID NO: 24931 - DNA, 20 bp, synthetic construct
  source 1..20: mol_type = other DNA
atttcaagacaagaccagag

SEQ ID NO: 24932 - DNA, 20 bp, synthetic construct
  source 1..20: mol_type = other DNA
tgctcccaccacttcaacaa

SEQ ID NO: 24933 - DNA, 20 bp, synthetic construct
  source 1..20: mol_type = other DNA
ttccacagaagagaccttcg

SEQ ID NO: 24934 - DNA, 20 bp, synthetic construct
  source 1..20: mol_type = other DNA
cgccatggcacggaagaagc

SEQ ID NO: 24935 - DNA, 20 bp, synthetic construct
  source 1..20: mol_type = other DNA
gggtttggaccagttaggct

SEQ ID NO: 24936 - DNA, 20 bp, synthetic construct
  source 1..20: mol_type = other DNA
atggatgttggcgaactctg

SEQ ID NO: 24937 - DNA, 20 bp, synthetic construct
  source 1..20: mol_type = other DNA
cttctcaagacagctgcctc

SEQ ID NO: 24938 - DNA, 20 bp, synthetic construct
  source 1..20: mol_type = other DNA
aggacgctgtttggtggcat

SEQ ID NO: 24939 - DNA, 20 bp, synthetic construct
  source 1..20: mol_type = other DNA
catttgatcatcccacacac

SEQ ID NO: 24940 - DNA, 20 bp, synthetic construct
  source 1..20: mol_type = other DNA
gggacagcgttcgctgaagt

SEQ ID NO: 24941 - DNA, 20 bp, synthetic construct
  source 1..20: mol_type = other DNA
gggatgttgggcctggtgat

SEQ ID NO: 24942 - DNA, 20 bp, synthetic construct
  source 1..20: mol_type = other DNA
accagcccaaggcttgatgt

SEQ ID NO: 24943 - DNA, 20 bp, synthetic construct
  source 1..20: mol_type = other DNA
gggatattcaacacagccac

SEQ ID NO: 24944 - DNA, 20 bp, synthetic construct
  source 1..20: mol_type = other DNA
gagacccaaccacaggtggt

SEQ ID NO: 24945 - DNA, 20 bp, synthetic construct
  source 1..20: mol_type = other DNA
gagatgggtgaggctctgaa

SEQ ID NO: 24946 - DNA, 20 bp, synthetic construct
  source 1..20: mol_type = other DNA
aaagggtttgaatgggtcac

SEQ ID NO: 24947 - DNA, 20 bp, synthetic construct
  source 1..20: mol_type = other DNA
tttgtgatcacaacagacat

SEQ ID NO: 24948 - DNA, 20 bp, synthetic construct
  source 1..20: mol_type = other DNA
aatccgagtagaacaggtga

SEQ ID NO: 24949 - DNA, 20 bp, synthetic construct
  source 1..20: mol_type = other DNA
atctacagactgcgggagcc

SEQ ID NO: 24950 - DNA, 20 bp, synthetic construct
  source 1..20: mol_type = other DNA
atagggaaaatgactgcggg

SEQ ID NO: 24951 - DNA, 20 bp, synthetic construct
  source 1..20: mol_type = other DNA
ctgtacgcagtcattaccat

SEQ ID NO: 24952 - DNA, 20 bp, synthetic construct
  source 1..20: mol_type = other DNA
ccaaagggaacatccgcctc

SEQ ID NO: 24953 - DNA, 20 bp, synthetic construct
  source 1..20: mol_type = other DNA
gcagacttggatgacgaagc

SEQ ID NO: 24954 - DNA, 20 bp, synthetic construct
  source 1..20: mol_type = other DNA
caggtggtgacatacgcact

SEQ ID NO: 24955 - DNA, 20 bp, synthetic construct
  source 1..20: mol_type = other DNA
ctaaacaaaaaccgttgcac

SEQ ID NO: 24956 - DNA, 20 bp, synthetic construct
  source 1..20: mol_type = other DNA
cccgcgcccataaccaacat

SEQ ID NO: 24957 - DNA, 20 bp, synthetic construct
  source 1..20: mol_type = other DNA
ggagtaggaccagtcagaat

SEQ ID NO: 24958 - DNA, 20 bp, synthetic construct
  source 1..20: mol_type = other DNA
gttgtgaaagctctggatgt

SEQ ID NO: 24959 - DNA, 20 bp, synthetic construct
  source 1..20: mol_type = other DNA
tctatcacagtgcaccatca

SEQ ID NO: 24960 - DNA, 20 bp, synthetic construct
  source 1..20: mol_type = other DNA
gatgtgaagatgatgaacat

SEQ ID NO: 24961 - DNA, 20 bp, synthetic construct
  source 1..20: mol_type = other DNA
ggttggggtaatggttgtgg

SEQ ID NO: 24962 - DNA, 20 bp, synthetic construct
  source 1..20: mol_type = other DNA
tctgatggaccatgtcgtat

SEQ ID NO: 24963 - DNA, 20 bp, synthetic construct
  source 1..20: mol_type = other DNA
ctggagcataacatgtggaa

SEQ ID NO: 24964 - DNA, 20 bp, synthetic construct
  source 1..20: mol_type = other DNA
gttgcctccgccagaacaac

SEQ ID NO: 24965 - DNA, 20 bp, synthetic construct
  source 1..20: mol_type = other DNA
gcgttgcacgactggaacat

SEQ ID NO: 24966 - DNA, 20 bp, synthetic construct
  source 1..20: mol_type = other DNA
cttatcatcggagttatgtc

SEQ ID NO: 24967 - DNA, 20 bp, synthetic construct
  source 1..20: mol_type = other DNA
gaggatgcccaaataacagg

SEQ ID NO: 24968 - DNA, 20 bp, synthetic construct
  source 1..20: mol_type = other DNA
atgtggcatgtgacgaatgg

SEQ ID NO: 24969 - DNA, 20 bp, synthetic construct
  source 1..20: mol_type = other DNA
atttcccaaggccagcgaat

SEQ ID NO: 24970 - DNA, 20 bp, synthetic construct
  source 1..20: mol_type = other DNA
ttgtttgtgatggatgaagc

SEQ ID NO: 24971 - DNA, 20 bp, synthetic construct
  source 1..20: mol_type = other DNA
aaaatgcttccagagcattt

SEQ ID NO: 24972 - DNA, 20 bp, synthetic construct
  source 1..20: mol_type = other DNA
gatggaatcgtggcaacgga

SEQ ID NO: 24973 - DNA, 20 bp, synthetic construct
  source 1..20: mol_type = other DNA
acctggaactaccatggaag

SEQ ID NO: 24974 - DNA, 20 bp, synthetic construct
  source 1..20: mol_type = other DNA
aagtgggcatcagctcggga

SEQ ID NO: 24975 - DNA, 20 bp, synthetic construct
  source 1..20: mol_type = other DNA
gatgtgatttccagggaaga

SEQ ID NO: 24976 - DNA, 20 bp, synthetic construct
  source 1..20: mol_type = other DNA
gacgtccctttctgttcaca

SEQ ID NO: 24977 - DNA, 20 bp, synthetic construct
  source 1..20: mol_type = other DNA
ctactcatgtactttcacag

SEQ ID NO: 24978 - DNA, 20 bp, synthetic construct
  source 1..20: mol_type = other DNA
aacgaacacatggaagacaa

SEQ ID NO: 24979 - DNA, 20 bp, synthetic construct
  source 1..20: mol_type = other DNA
agtcaggccacaggttttgt

SEQ ID NO: 24980 - DNA, 20 bp, synthetic construct
  source 1..20: mol_type = other DNA
ggccaaaaggtctcgctccc

SEQ ID NO: 24981 - DNA, 20 bp, synthetic construct
  source 1..20: mol_type = other DNA
gccctgttcatgtccattga

SEQ ID NO: 24982 - DNA, 20 bp, synthetic construct
  source 1..20: mol_type = other DNA
atttacgaagggaaaacaaa

SEQ ID NO: 24983 - DNA, 20 bp, synthetic construct
  source 1..20: mol_type = other DNA
aatcgatgtgtgggaaagaa

SEQ ID NO: 24984 - DNA, 20 bp, synthetic construct
  source 1..20: mol_type = other DNA
gcggctatgacttgtcgctt

SEQ ID NO: 24985 - DNA, 20 bp, synthetic construct
  source 1..20: mol_type = other DNA
cagagtggctttggatacag

SEQ ID NO: 24986 - DNA, 20 bp, synthetic construct
  source 1..20: mol_type = other DNA
tcactcttgattggcggtgc

SEQ ID NO: 24987 - DNA, 20 bp, synthetic construct
  source 1..20: mol_type = other DNA
aactcgacgttgctcgtcct

SEQ ID NO: 24988 - DNA, 20 bp, synthetic construct
  source 1..20: mol_type = other DNA
ccgacgtacctggccggttc

SEQ ID NO: 24989 - DNA, 20 bp, synthetic construct
  source 1..20: mol_type = other DNA
aacgatagtacattgtttat

SEQ ID NO: 24990 - DNA, 20 bp, synthetic construct
  source 1..20: mol_type = other DNA
atagacgagatggatcagat

SEQ ID NO: 24991 - DNA, 20 bp, synthetic construct
  source 1..20: mol_type = other DNA
tggtttactgaagcatacgt

SEQ ID NO: 24992 - DNA, 20 bp, synthetic construct
  source 1..20: mol_type = other DNA
tttttcaagtatcacacagg

SEQ ID NO: 24993 - DNA, 20 bp, synthetic construct
  source 1..20: mol_type = other DNA
atcaaacaaacaaagagatt

SEQ ID NO: 24994 - DNA, 20 bp, synthetic construct
  source 1..20: mol_type = other DNA
gagaaaggcattgacagcat

SEQ ID NO: 24995 - DNA, 20 bp, synthetic construct
  source 1..20: mol_type = other DNA
cggcgtggaagaactggacg

SEQ ID NO: 24996 - DNA, 20 bp, synthetic construct
  source 1..20: mol_type = other DNA
gcccccaggttccacgacga

SEQ ID NO: 24997 - DNA, 20 bp, synthetic construct
  source 1..20: mol_type = other DNA
cgcgacacaatcgaaaacct

SEQ ID NO: 24998 - DNA, 20 bp, synthetic construct
  source 1..20: mol_type = other DNA
gcgtccgtgattggaggagt

SEQ ID NO: 24999 - DNA, 20 bp, synthetic construct
  source 1..20: mol_type = other DNA
tcgctggtgaagactgacac

SEQ ID NO: 25000 - DNA, 20 bp, synthetic construct
  source 1..20: mol_type = other DNA
ggcgtcgacgtgtatgccga

SEQ ID NO: 25001 - DNA, 20 bp, synthetic construct
  source 1..20: mol_type = other DNA
ccctatcacatcgaagtgct

SEQ ID NO: 25002 - DNA, 20 bp, synthetic construct
  source 1..20: mol_type = other DNA
cagtccttcaactaccacgg

SEQ ID NO: 25003 - DNA, 20 bp, synthetic construct
  source 1..20: mol_type = other DNA
gtcgacacgctaacagtcga

SEQ ID NO: 25004 - DNA, 20 bp, synthetic construct
  source 1..20: mol_type = other DNA
tcccaccatttccacgcctt

SEQ ID NO: 25005 - DNA, 20 bp, synthetic construct
  source 1..20: mol_type = other DNA
caccggcgagacctgcggct

SEQ ID NO: 25006 - DNA, 20 bp, synthetic construct
  source 1..20: mol_type = other DNA
accaaagaccttgtcaaagc

SEQ ID NO: 25007 - DNA, 20 bp, synthetic construct
  source 1..20: mol_type = other DNA
ggtttccagcccgcgcaagg

SEQ ID NO: 25008 - DNA, 20 bp, synthetic construct
  source 1..20: mol_type = other DNA
aaaacaaaacaaagtgcaag

SEQ ID NO: 25009 - DNA, 20 bp, synthetic construct
  source 1..20: mol_type = other DNA
ggactggctggtcgcaagaa

SEQ ID NO: 25010 - DNA, 20 bp, synthetic construct
  source 1..20: mol_type = other DNA
gtcaacactttggatgcggg

SEQ ID NO: 25011 - DNA, 20 bp, synthetic construct
  source 1..20: mol_type = other DNA
agggtagttattgccatctt

SEQ ID NO: 25012 - DNA, 20 bp, synthetic construct
  source 1..20: mol_type = other DNA
gtgacttttgttccgaccac

SEQ ID NO: 25013 - DNA, 20 bp, synthetic construct
  source 1..20: mol_type = other DNA
tggcagagtggaacaggagg

SEQ ID NO: 25014 - DNA, 20 bp, synthetic construct
  source 1..20: mol_type = other DNA
ggaggtcatgtgacgtgtaa

SEQ ID NO: 25015 - DNA, 20 bp, synthetic construct
  source 1..20: mol_type = other DNA
ataaccaagatattgattgg

SEQ ID NO: 25016 - DNA, 20 bp, synthetic construct
  source 1..20: mol_type = other DNA
aagatcatacctgaatggtg

SEQ ID NO: 25017 - DNA, 20 bp, synthetic construct
  source 1..20: mol_type = other DNA
gctggcatgggactgaagga

SEQ ID NO: 25018 - DNA, 20 bp, synthetic construct
  source 1..20: mol_type = other DNA
gtggaacaaactgacacagg

SEQ ID NO: 25019 - DNA, 20 bp, synthetic construct
  source 1..20: mol_type = other DNA
aaaaacggaaaagaaatagg

SEQ ID NO: 25020 - DNA, 20 bp, synthetic construct
  source 1..20: mol_type = other DNA
gaaacacgactaagagaaga

SEQ ID NO: 25021 - DNA, 20 bp, synthetic construct
  source 1..20: mol_type = other DNA
aaaatgcgggaagcgatcga

SEQ ID NO: 25022 - DNA, 20 bp, synthetic construct
  source 1..20: mol_type = other DNA
attgctgtagcgttttcagg

SEQ ID NO: 25023 - DNA, 20 bp, synthetic construct
  source 1..20: mol_type = other DNA
aaagtgccagacattactga

SEQ ID NO: 25024 - DNA, 20 bp, synthetic construct
  source 1..20: mol_type = other DNA
cccactggaacgcgaagcgt

SEQ ID NO: 25025 - DNA, 20 bp, synthetic construct
  source 1..20: mol_type = other DNA
aaactggttgatgatgagag

SEQ ID NO: 25026 - DNA, 20 bp, synthetic construct
  source 1..20: mol_type = other DNA
acttatgccctgaacaccgt

SEQ ID NO: 25027 - DNA, 20 bp, synthetic construct
  source 1..20: mol_type = other DNA
gcaatcaactcgaccgttcc

SEQ ID NO: 25028 - DNA, 20 bp, synthetic construct
  source 1..20: mol_type = other DNA
tgactctcacgcttactcca

SEQ ID NO: 25029 - DNA, 20 bp, synthetic construct
  source 1..20: mol_type = other DNA
tcatgccagccccaataaca

SEQ ID NO: 25030 - DNA, 20 bp, synthetic construct
  source 1..20: mol_type = other DNA
tgggtcgttactttggaaat

SEQ ID NO: 25031 - DNA, 20 bp, synthetic construct
  source 1..20: mol_type = other DNA
agtccacctttgaatttgtt

SEQ ID NO: 25032 - DNA, 20 bp, synthetic construct
  source 1..20: mol_type = other DNA
cctataccgtttttgctatg

SEQ ID NO: 25033 - DNA, 20 bp, synthetic construct
  source 1..20: mol_type = other DNA
atgtgcccagacctttaccc

SEQ ID NO: 25034 - DNA, 20 bp, synthetic construct
  source 1..20: mol_type = other DNA
ttggagtaacccccggttca

SEQ ID NO: 25035 - DNA, 20 bp, synthetic construct
  source 1..20: mol_type = other DNA
gcccggagtggaaaaacctt

SEQ ID NO: 25036 - DNA, 20 bp, synthetic construct
  source 1..20: mol_type = other DNA
ctaaacacgtgaataacgtg

SEQ ID NO: 25037 - DNA, 20 bp, synthetic construct
  source 1..20: mol_type = other DNA
caggtttgccctacaaaaag

SEQ ID NO: 25038 - DNA, 20 bp, synthetic construct
  source 1..20: mol_type = other DNA
tacgtggtgggctgccttca

SEQ ID NO: 25039 - DNA, 20 bp, synthetic construct
  source 1..20: mol_type = other DNA
tttcttggtataaacctgga

SEQ ID NO: 25040 - DNA, 20 bp, synthetic construct
  source 1..20: mol_type = other DNA
gatgctggatggtcacgttg

SEQ ID NO: 25041 - DNA, 20 bp, synthetic construct
  source 1..20: mol_type = other DNA
gtagcgatgctgtgtgtgtg

SEQ ID NO: 25042 - DNA, 20 bp, synthetic construct
  source 1..20: mol_type = other DNA
ttgatgcttctgcccaaggt

SEQ ID NO: 25043 - DNA, 20 bp, synthetic construct
  source 1..20: mol_type = other DNA
atcctaaagacacaaatgtt

SEQ ID NO: 25044 - DNA, 20 bp, synthetic construct
  source 1..20: mol_type = other DNA
ttgctaaagtgcccagtttt

SEQ ID NO: 25045 - DNA, 20 bp, synthetic construct
  source 1..20: mol_type = other DNA
attttgtagtcccttttata

SEQ ID NO: 25046 - DNA, 20 bp, synthetic construct
  source 1..20: mol_type = other DNA
cttccttcctgtttgctcaa

SEQ ID NO: 25047 - DNA, 20 bp, synthetic construct
  source 1..20: mol_type = other DNA
gtgactcctttcagagaccg

SEQ ID NO: 25048 - DNA, 20 bp, synthetic construct
  source 1..20: mol_type = other DNA
taggcaaatctgctgcagct

SEQ ID NO: 25049 - DNA, 20 bp, synthetic construct
  source 1..20: mol_type = other DNA
gtttctgtcaaatggtttct

SEQ ID NO: 25050 - DNA, 20 bp, synthetic construct
  source 1..20: mol_type = other DNA
cctttgtaatgctttacaaa

SEQ ID NO: 25051 - DNA, 20 bp, synthetic construct
  source 1..20: mol_type = other DNA
aggtgatcttctcaaaacat

SEQ ID NO: 25052 - DNA, 20 bp, synthetic construct
  source 1..20: mol_type = other DNA
aaaaggtcaaagcaggaaag

SEQ ID NO: 25053 - DNA, 20 bp, synthetic construct
  source 1..20: mol_type = other DNA
aactcagtggctttccttat

SEQ ID NO: 25054 - DNA, 20 bp, synthetic construct
  source 1..20: mol_type = other DNA
acaagagactccagattgct

SEQ ID NO: 25055 - DNA, 20 bp, synthetic construct
  source 1..20: mol_type = other DNA
acctcgaggcaatgttgtct

SEQ ID NO: 25056 - DNA, 20 bp, synthetic construct
  source 1..20: mol_type = other DNA
taaagttgtcaatatgggtg

SEQ ID NO: 25057 - DNA, 20 bp, synthetic construct
  source 1..20: mol_type = other DNA
tggaatggcaagttctgctt

SEQ ID NO: 25058 - DNA, 20 bp, synthetic construct
  source 1..20: mol_type = other DNA
ggaaattgcccactcacact

SEQ ID NO: 25059 - DNA, 20 bp, synthetic construct
  source 1..20: mol_type = other DNA
cagacctttccaccactctt

SEQ ID NO: 25060 - DNA, 20 bp, synthetic construct
  source 1..20: mol_type = other DNA
tcaaccttactttgagattt

SEQ ID NO: 25061 - DNA, 20 bp, synthetic construct
  source 1..20: mol_type = other DNA
taagggcaagttgcttcttt

SEQ ID NO: 25062 - DNA, 20 bp, synthetic construct
  source 1..20: mol_type = other DNA
ctccgtggtaaacacggatg

SEQ ID NO: 25063 - DNA, 20 bp, synthetic construct
  source 1..20: mol_type = other DNA
tgacaatgcggagaaaggta

SEQ ID NO: 25064 - DNA, 20 bp, synthetic construct
  source 1..20: mol_type = other DNA
tagtacaaccactgttacat

SEQ ID NO: 25065 - DNA, 20 bp, synthetic construct
  source 1..20: mol_type = other DNA
tgacaagaaatcactcaagg

SEQ ID NO: 25066 - DNA, 20 bp, synthetic construct
  source 1..20: mol_type = other DNA
tgtcagcaagctgaaaagaa

SEQ ID NO: 25067 - DNA, 20 bp, synthetic construct
  source 1..20: mol_type = other DNA
catatttgaaatcttggaag

SEQ ID NO: 25068 - DNA, 20 bp, synthetic construct
  source 1..20: mol_type = other DNA
tactgccatggaaacagctt

SEQ ID NO: 25069 - DNA, 20 bp, synthetic construct
  source 1..20: mol_type = other DNA
gcggcctccacgctctttgt

SEQ ID NO: 25070 - DNA, 20 bp, synthetic construct
  source 1..20: mol_type = other DNA
accagggtttaggtctttca

SEQ ID NO: 25071 - DNA, 20 bp, synthetic construct
  source 1..20: mol_type = other DNA
tgacacaaaattctggacag

SEQ ID NO: 25072 - DNA, 20 bp, synthetic construct
  source 1..20: mol_type = other DNA
gtgtggcccctgcaaaccac

SEQ ID NO: 25073 - DNA, 20 bp, synthetic construct
  source 1..20: mol_type = other DNA
acggcatttctttccttgac

SEQ ID NO: 25074 - DNA, 20 bp, synthetic construct
  source 1..20: mol_type = other DNA
tggtggtgcagtcgcccaaa

SEQ ID NO: 25075 - DNA, 20 bp, synthetic construct
  source 1..20: mol_type = other DNA
ccttgataaaacagtttctc

SEQ ID NO: 25076 - DNA, 20 bp, synthetic construct
  source 1..20: mol_type = other DNA
caattgactcagttgaacaa

SEQ ID NO: 25077 - DNA, 20 bp, synthetic construct
  source 1..20: mol_type = other DNA
ctctacacccaggaaccagg

SEQ ID NO: 25078 - DNA, 20 bp, synthetic construct
  source 1..20: mol_type = other DNA
ccagaattggtgattgtccc

SEQ ID NO: 25079 - DNA, 20 bp, synthetic construct
  source 1..20: mol_type = other DNA
agtccatctttgaacttctt

SEQ ID NO: 25080 - DNA, 20 bp, synthetic construct
  source 1..20: mol_type = other DNA
acgcgatttaccaaggaaag

SEQ ID NO: 25081 - DNA, 20 bp, synthetic construct
  source 1..20: mol_type = other DNA
gtgtaattggtataacatag

SEQ ID NO: 25082 - DNA, 20 bp, synthetic construct
  source 1..20: mol_type = other DNA
gaagggtaagaaattctctt

SEQ ID NO: 25083 - DNA, 20 bp, synthetic construct
  source 1..20: mol_type = other DNA
tactaggattgtgggaccag

SEQ ID NO: 25084 - DNA, 20 bp, synthetic construct
  source 1..20: mol_type = other DNA
cgcaccaatcgtgttaatgg

SEQ ID NO: 25085 - DNA, 20 bp, synthetic construct
  source 1..20: mol_type = other DNA
tagggcgtggtatgaggaag

SEQ ID NO: 25086 - DNA, 20 bp, synthetic construct
  source 1..20: mol_type = other DNA
cggaatgactctggctgact

SEQ ID NO: 25087 - DNA, 20 bp, synthetic construct
  source 1..20: mol_type = other DNA
ggtggggaacctgggatccg

SEQ ID NO: 25088 - DNA, 20 bp, synthetic construct
  source 1..20: mol_type = other DNA
caggttccctacatcactaa

SEQ ID NO: 25089 - DNA, 20 bp, synthetic construct
  source 1..20: mol_type = other DNA
tctgaagaacttaaaaggct

SEQ ID NO: 25090 - DNA, 20 bp, synthetic construct
  source 1..20: mol_type = other DNA
tcccagtattgccttcaacc

SEQ ID NO: 25091 - DNA, 20 bp, synthetic construct
  source 1..20: mol_type = other DNA
agctggacttaagataccaa

SEQ ID NO: 25092 - DNA, 20 bp, synthetic construct
  source 1..20: mol_type = other DNA
gcggggtagagtaggacggg

SEQ ID NO: 25093 - DNA, 20 bp, synthetic construct
  source 1..20: mol_type = other DNA
ggaagacagcttgttaataa

SEQ ID NO: 25094 - DNA, 20 bp, synthetic construct
  source 1..20: mol_type = other DNA
aaaacaggtatcaggtttat

SEQ ID NO: 25095 - DNA, 20 bp, synthetic construct
  source 1..20: mol_type = other DNA
aatgatgtcccaaaacccag

SEQ ID NO: 25096 - DNA, 20 bp, synthetic construct
  source 1..20: mol_type = other DNA
tgcagagttgaaaccggtaa

SEQ ID NO: 25097 - DNA, 20 bp, synthetic construct
  source 1..20: mol_type = other DNA
ggaggaaaaggcaatacccc

SEQ ID NO: 25098 - DNA, 20 bp, synthetic construct
  source 1..20: mol_type = other DNA
gagacccttatttgaggaac

SEQ ID NO: 25099 - DNA, 20 bp, synthetic construct
  source 1..20: mol_type = other DNA
cttgaaattaaaagatcttt

SEQ ID NO: 25100 - DNA, 20 bp, synthetic construct
  source 1..20: mol_type = other DNA
atgggtcaagcaaaaacctg

SEQ ID NO: 25101 - DNA, 20 bp, synthetic construct
  source 1..20: mol_type = other DNA
aatactagaaggagaccaaa

SEQ ID NO: 25102 - DNA, 20 bp, synthetic construct
  source 1..20: mol_type = other DNA
gggcactgccgcatatgaga

SEQ ID NO: 25103 - DNA, 20 bp, synthetic construct
  source 1..20: mol_type = other DNA
agtttctagcaagactggca

SEQ ID NO: 25104 - DNA, 20 bp, synthetic construct
  source 1..20: mol_type = other DNA
tcaattataaacttccggct

SEQ ID NO: 25105 - DNA, 20 bp, synthetic construct
  source 1..20: mol_type = other DNA
aaccacggccggcttcgcac

SEQ ID NO: 25106 - DNA, 20 bp, synthetic construct
  source 1..20: mol_type = other DNA
aatgcctgaccatggtaaat

SEQ ID NO: 25107 - DNA, 20 bp, synthetic construct
  source 1..20: mol_type = other DNA
gtctcgtcacaccggtagcc

SEQ ID NO: 25108 - DNA, 20 bp, synthetic construct
  source 1..20: mol_type = other DNA
aagatcactccgttgagctc

SEQ ID NO: 25109 - DNA, 20 bp, synthetic construct
  source 1..20: mol_type = other DNA
acaccactctatcgtacaac

SEQ ID NO: 25110 - DNA, 20 bp, synthetic construct
  source 1..20: mol_type = other DNA
caactgtcgcgatgcttact

SEQ ID NO: 25111 - DNA, 20 bp, synthetic construct
  source 1..20: mol_type = other DNA
agatcctcacgttttgcttg

SEQ ID NO: 25112 - DNA, 20 bp, synthetic construct
  source 1..20: mol_type = other DNA
aagggggaaacttccgtgac

SEQ ID NO: 25113 - DNA, 20 bp, synthetic construct
  source 1..20: mol_type = other DNA
agcgtggagtaggtgtggca

SEQ ID NO: 25114 - DNA, 20 bp, synthetic construct
  source 1..20: mol_type = other DNA
ggaccataatcctgacaccc

SEQ ID NO: 25115 - DNA, 20 bp, synthetic construct
  source 1..20: mol_type = other DNA
gggtggcgctcattgtcatg

SEQ ID NO: 25116 - DNA, 20 bp, synthetic construct
  source 1..20: mol_type = other DNA
ctagtagcgacgaaacctct

SEQ ID NO: 25117 - DNA, 20 bp, synthetic construct
  source 1..20: mol_type = other DNA
ccttagttggggaagacctg

SEQ ID NO: 25118 - DNA, 20 bp, synthetic construct
  source 1..20: mol_type = other DNA
caatgctgtcggccattgga

SEQ ID NO: 25119 - DNA, 20 bp, synthetic construct
  source 1..20: mol_type = other DNA
tggaggagacagtgacgtcc

SEQ ID NO: 25120 - DNA, 20 bp, synthetic construct
  source 1..20: mol_type = other DNA
acccaaatctcaccaaagag

SEQ ID NO: 25121 - DNA, 20 bp, synthetic construct
  source 1..20: mol_type = other DNA
gcttggcacacagtaggaat

SEQ ID NO: 25122 - DNA, 20 bp, synthetic construct
  source 1..20: mol_type = other DNA
cagcagctagcgtgtctgcc

SEQ ID NO: 25123 - DNA, 20 bp, synthetic construct
  source 1..20: mol_type = other DNA
gggtcagtcgtgaaaacttt

SEQ ID NO: 25124 - DNA, 20 bp, synthetic construct
  source 1..20: mol_type = other DNA
aactgactgcaaaccccttc

SEQ ID NO: 25125 - DNA, 20 bp, synthetic construct
  source 1..20: mol_type = other DNA
ttgcctcttccttagactac

SEQ ID NO: 25126 - DNA, 20 bp, synthetic construct
  source 1..20: mol_type = other DNA
tcgggcgaacatcctggtca

SEQ ID NO: 25127 - DNA, 20 bp, synthetic construct
  source 1..20: mol_type = other DNA
gcaagaatgccatcatctgt

SEQ ID NO: 25128 - DNA, 20 bp, synthetic construct
  source 1..20: mol_type = other DNA
tcgttggctggcctttcttc

SEQ ID NO: 25129 - DNA, 20 bp, synthetic construct
  source 1..20: mol_type = other DNA
tgcctggcggctttgcgcta

SEQ ID NO: 25130 - DNA, 20 bp, synthetic construct
  source 1..20: mol_type = other DNA
aacgacgtcaccacagacgt

SEQ ID NO: 25131 - DNA, 20 bp, synthetic construct
  source 1..20: mol_type = other DNA
gccggtggtgccccctctgc

SEQ ID NO: 25132 - DNA, 20 bp, synthetic construct
  source 1..20: mol_type = other DNA
tcttggtctgagacgatcgc

SEQ ID NO: 25133 - DNA, 20 bp, synthetic construct
  source 1..20: mol_type = other DNA
ttcaactgtggcttcgatgt

SEQ ID NO: 25134 - DNA, 20 bp, synthetic construct
  source 1..20: mol_type = other DNA
tcgggagccgatggtgcaga

SEQ ID NO: 25135 - DNA, 20 bp, synthetic construct
  source 1..20: mol_type = other DNA
ttctatgcccccccgggtgc

SEQ ID NO: 25136 - DNA, 20 bp, synthetic construct
  source 1..20: mol_type = other DNA
caaaacggcggagatgcagg

SEQ ID NO: 25137 - DNA, 20 bp, synthetic construct
  source 1..20: mol_type = other DNA
tccatcgttcgtgtcgctcg

SEQ ID NO: 25138 - DNA, 20 bp, synthetic construct
  source 1..20: mol_type = other DNA
atgttctctcatggcgacga

SEQ ID NO: 25139 - DNA, 20 bp, synthetic construct
  source 1..20: mol_type = other DNA
cgcgcagtccccccccttac

SEQ ID NO: 25140 - DNA, 20 bp, synthetic construct
  source 1..20: mol_type = other DNA
ctttccgccgcgctcgagag

SEQ ID NO: 25141 - DNA, 20 bp, synthetic construct
  source 1..20: mol_type = other DNA
ttctcagcggcggctgctct

SEQ ID NO: 25142 - DNA, 20 bp, synthetic construct
  source 1..20: mol_type = other DNA
agctcccttcgcgaccgggc

SEQ ID NO: 25143 - DNA, 20 bp, synthetic construct
  source 1..20: mol_type = other DNA
cgccctgtctctttcctctc

SEQ ID NO: 25144 - DNA, 20 bp, synthetic construct
  source 1..20: mol_type = other DNA
ctcccaaaacaacctgtgta

SEQ ID NO: 25145 - DNA, 20 bp, synthetic construct
  source 1..20: mol_type = other DNA
atcctcggtatccacgtcgc

SEQ ID NO: 25146 - DNA, 20 bp, synthetic construct
  source 1..20: mol_type = other DNA
atccctcccgcctttggtgc

SEQ ID NO: 25147 - DNA, 20 bp, synthetic construct
  source 1..20: mol_type = other DNA
tcccagcttcctgataacct

SEQ ID NO: 25148 - DNA, 20 bp, synthetic construct
  source 1..20: mol_type = other DNA
gccatcgattccgtctggga

SEQ ID NO: 25149 - DNA, 20 bp, synthetic construct
  source 1..20: mol_type = other DNA
ggtaaccctctccagcatgg

SEQ ID NO: 25150 - DNA, 20 bp, synthetic construct
  source 1..20: mol_type = other DNA
tttgacatcactttccttaa

SEQ ID NO: 25151 - DNA, 20 bp, synthetic construct
  source 1..20: mol_type = other DNA
aactactcggcttggtgtga

SEQ ID NO: 25152 - DNA, 20 bp, synthetic construct
  source 1..20: mol_type = other DNA
ggcccacccacagcaagaat

SEQ ID NO: 25153 - DNA, 20 bp, synthetic construct
  source 1..20: mol_type = other DNA
ttccccttcctcccataact

SEQ ID NO: 25154 - DNA, 20 bp, synthetic construct
  source 1..20: mol_type = other DNA
ccggtggggtaaggttggtg

SEQ ID NO: 25155 - DNA, 20 bp, synthetic construct
  source 1..20: mol_type = other DNA
ggattttcgagttcgttggc

SEQ ID NO: 25156 - DNA, 20 bp, synthetic construct
  source 1..20: mol_type = other DNA
tggtgggagcccgcggccgc

SEQ ID NO: 25157 - DNA, 20 bp, synthetic construct
  source 1..20: mol_type = other DNA
ctcaaacttccttacattgg

SEQ ID NO: 25158 - DNA, 20 bp, synthetic construct
  source 1..20: mol_type = other DNA
ggtcctgctcagtgctacgg

SEQ ID NO: 25159 - DNA, 20 bp, synthetic construct
  source 1..20: mol_type = other DNA
tcgggagctgatggcgcaga

SEQ ID NO: 25160 - DNA, 20 bp, synthetic construct
  source 1..20: mol_type = other DNA
ttttatgcccctcccggtgc

SEQ ID NO: 25161 - DNA, 20 bp, synthetic construct
  source 1..20: mol_type = other DNA
tccatcgttcgtgtcgcccg

SEQ ID NO: 25162 - DNA, 20 bp, synthetic construct
  source 1..20: mol_type = other DNA
caacacctctttgccaagct

SEQ ID NO: 25163 - DNA, 20 bp, synthetic construct
  source 1..20: mol_type = other DNA
cttggggtcctcgtcaaaga

SEQ ID NO: 25164 - DNA, 20 bp, synthetic construct
  source 1..20: mol_type = other DNA
gctgccaactctgtcaccca

SEQ ID NO: 25165 - DNA, 20 bp, synthetic construct
  source 1..20: mol_type = other DNA
tctactcttgctcaggccct

SEQ ID NO: 25166 - DNA, 20 bp, synthetic construct
  source 1..20: mol_type = other DNA
ggctctcttcgcgatcgggc

SEQ ID NO: 25167 - DNA, 20 bp, synthetic construct
  source 1..20: mol_type = other DNA
cgcccggtctctttcctctc

SEQ ID NO: 25168 - DNA, 20 bp, synthetic construct
  source 1..20: mol_type = other DNA
cagctccctgacagcctccc

SEQ ID NO: 25169 - DNA, 20 bp, synthetic construct
  source 1..20: mol_type = other DNA
aaccctctccagtatggcag

SEQ ID NO: 25170 - DNA, 20 bp, synthetic construct
  source 1..20: mol_type = other DNA
agcaaaatgggagctcaggt

SEQ ID NO: 25171 - DNA, 20 bp, synthetic construct
  source 1..20: mol_type = other DNA
acgggctacactgttcacgt

SEQ ID NO: 25172 - DNA, 20 bp, synthetic construct
  source 1..20: mol_type = other DNA
gatgactttcaatccccctc

SEQ ID NO: 25173 - DNA, 20 bp, synthetic construct
  source 1..20: mol_type = other DNA
attactgcttggtaccaaac

SEQ ID NO: 25174 - DNA, 20 bp, synthetic construct
  source 1..20: mol_type = other DNA
tatgtcggtaactatagagt

SEQ ID NO: 25175 - DNA, 20 bp, synthetic construct
  source 1..20: mol_type = other DNA
caagactccattctagagaa

SEQ ID NO: 25176 - DNA, 20 bp, synthetic construct
  source 1..20: mol_type = other DNA
ctagtgtgtggtaaagccat

SEQ ID NO: 25177 - DNA, 20 bp, synthetic construct
  source 1..20: mol_type = other DNA
cgcatgctaatgtacaactt

SEQ ID NO: 25178 - DNA, 20 bp, synthetic construct
  source 1..20: mol_type = other DNA
atcaagaagagagatatttt

SEQ ID NO: 25179 - DNA, 20 bp, synthetic construct
  source 1..20: mol_type = other DNA
gattcagtagctatgaggca

SEQ ID NO: 25180 - DNA, 20 bp, synthetic construct
  source 1..20: mol_type = other DNA
gtgcgatccttatgcctatt

SEQ ID NO: 25181 - DNA, 20 bp, synthetic construct
  source 1..20: mol_type = other DNA
cagcaaaatgggagctcaag

SEQ ID NO: 25182 - DNA, 20 bp, synthetic construct
  source 1..20: mol_type = other DNA
ggaggcgacagcggaggatc

SEQ ID NO: 25183 - DNA, 20 bp, synthetic construct
  source 1..20: mol_type = other DNA
ggcaggttacacgattcacg

SEQ ID NO: 25184 - DNA, 20 bp, synthetic construct
  source 1..20: mol_type = other DNA
tgacttccagtccccttgtg

SEQ ID NO: 25185 - DNA, 20 bp, synthetic construct
  source 1..20: mol_type = other DNA
gaacaagacccaagatcaag

SEQ ID NO: 25186 - DNA, 20 bp, synthetic construct
  source 1..20: mol_type = other DNA
gtactcccctccgggtgcgg

SEQ ID NO: 25187 - DNA, 20 bp, synthetic construct
  source 1..20: mol_type = other DNA
tgtccacgtggctgacacca

SEQ ID NO: 25188 - DNA, 20 bp, synthetic construct
  source 1..20: mol_type = other DNA
gagatcggcatgtgtgtaca

SEQ ID NO: 25189 - DNA, 20 bp, synthetic construct
  source 1..20: mol_type = other DNA
acacgtaagggtatggatcc

SEQ ID NO: 25190 - DNA, 20 bp, synthetic construct
  source 1..20: mol_type = other DNA
gtatgtgggcaattacagag

SEQ ID NO: 25191 - DNA, 20 bp, synthetic construct
  source 1..20: mol_type = other DNA
aaacaagcactatccagtcg

SEQ ID NO: 25192 - DNA, 20 bp, synthetic construct
  source 1..20: mol_type = other DNA
gggtggtgaaggtgttgttg

SEQ ID NO: 25193 - DNA, 20 bp, synthetic construct
  source 1..20: mol_type = other DNA
tcaagactccatcctggaaa

SEQ ID NO: 25194 - DNA, 20 bp, synthetic construct
  source 1..20: mol_type = other DNA
acaactgcccctgttggaaa

SEQ ID NO: 25195 - DNA, 20 bp, synthetic construct
  source 1..20: mol_type = other DNA
ggcaccagaaaccccccccc

SEQ ID NO: 25196 - DNA, 20 bp, synthetic construct
  source 1..20: mol_type = other DNA
ctccaaggaggctggtttcc

SEQ ID NO: 25197 - DNA, 20 bp, synthetic construct
  source 1..20: mol_type = other DNA
gaacacgaacgtggatgagt

SEQ ID NO: 25198 - DNA, 20 bp, synthetic construct
  source 1..20: mol_type = other DNA
tatcaaaaagagagacattt

SEQ ID NO: 25199 - DNA, 20 bp, synthetic construct
  source 1..20: mol_type = other DNA
tgattcagtggccatgaggc

SEQ ID NO: 25200 - DNA, 20 bp, synthetic construct
  source 1..20: mol_type = other DNA
tgtgcgatctttgtgcttat

SEQ ID NO: 25201 - DNA, 20 bp, synthetic construct
  source 1..20: mol_type = other DNA
agatgctctcaccgaagctg

SEQ ID NO: 25202 - DNA, 20 bp, synthetic construct
  source 1..20: mol_type = other DNA
gttcttggacaacggtacga

SEQ ID NO: 25203 - DNA, 20 bp, synthetic construct
  source 1..20: mol_type = other DNA
aaattttcattctactcccg

SEQ ID NO: 25204 - DNA, 20 bp, synthetic construct
  source 1..20: mol_type = other DNA
tttcacaattaatcctggta

SEQ ID NO: 25205 - DNA, 20 bp, synthetic construct
  source 1..20: mol_type = other DNA
ttacgatggttatccaagat

SEQ ID NO: 25206 - DNA, 20 bp, synthetic construct
  source 1..20: mol_type = other DNA
acccagaccatttaggatgt

SEQ ID NO: 25207 - DNA, 20 bp, synthetic construct
  source 1..20: mol_type = other DNA
atttattgaggccaatgagt

SEQ ID NO: 25208 - DNA, 20 bp, synthetic construct
  source 1..20: mol_type = other DNA
aaagtcagtggactcagagg

SEQ ID NO: 25209 - DNA, 20 bp, synthetic construct
  source 1..20: mol_type = other DNA
catactcatggctacaggta

SEQ ID NO: 25210 - DNA, 20 bp, synthetic construct
  source 1..20: mol_type = other DNA
actagaacccagcgtctttc

SEQ ID NO: 25211 - DNA, 20 bp, synthetic construct
  source 1..20: mol_type = other DNA
tggatacaccaacaatgaga

SEQ ID NO: 25212 - DNA, 20 bp, synthetic construct
  source 1..20: mol_type = other DNA
ttagacggaaatggcttgac

SEQ ID NO: 25213 - DNA, 20 bp, synthetic construct
  source 1..20: mol_type = other DNA
ttaaacctccgattcggcaa

SEQ ID NO: 25214 - DNA, 20 bp, synthetic construct
  source 1..20: mol_type = other DNA
ggcattgtgagacaacgggt

SEQ ID NO: 25215 - DNA, 20 bp, synthetic construct
  source 1..20: mol_type = other DNA
gaaagcaatgcagtcaagta

SEQ ID NO: 25216 - DNA, 20 bp, synthetic construct
  source 1..20: mol_type = other DNA
gcaacggcacacggcagtac

SEQ ID NO: 25217 - DNA, 20 bp, synthetic construct
  source 1..20: mol_type = other DNA
aaaatgcgttattaagaaaa

SEQ ID NO: 25218 - DNA, 20 bp, synthetic construct
  source 1..20: mol_type = other DNA
agacaattctgcattggaca

SEQ ID NO: 25219 - DNA, 20 bp, synthetic construct
  source 1..20: mol_type = other DNA
gtgagggaggcgcccggcga

SEQ ID NO: 25220 - DNA, 20 bp, synthetic construct
  source 1..20: mol_type = other DNA
aatcccaatctggcttcctc

SEQ ID NO: 25221 - DNA, 20 bp, synthetic construct
  source 1..20: mol_type = other DNA
ctcattccatcccaaattaa

SEQ ID NO: 25222 - DNA, 20 bp, synthetic construct
  source 1..20: mol_type = other DNA
actcctggttcacaggctga

SEQ ID NO: 25223 - DNA, 20 bp, synthetic construct
  source 1..20: mol_type = other DNA
attacacccgagcccaacac

SEQ ID NO: 25224 - DNA, 20 bp, synthetic construct
  source 1..20: mol_type = other DNA
aatcagctcaaaccgtctat

SEQ ID NO: 25225 - DNA, 20 bp, synthetic construct
  source 1..20: mol_type = other DNA
ttctaatactgttcttctgt

SEQ ID NO: 25226 - DNA, 20 bp, synthetic construct
  source 1..20: mol_type = other DNA
gggggttgtacacaacaata

SEQ ID NO: 25227 - DNA, 20 bp, synthetic construct
  source 1..20: mol_type = other DNA
cgcctttcacaaagaaggag

SEQ ID NO: 25228 - DNA, 20 bp, synthetic construct
  source 1..20: mol_type = other DNA
accacagaaagccacgccga

SEQ ID NO: 25229 - DNA, 20 bp, synthetic construct
  source 1..20: mol_type = other DNA
cgaagggatgtcactcccaa

SEQ ID NO: 25230 - DNA, 20 bp, synthetic construct
  source 1..20: mol_type = other DNA
ttgaggcagctggccaacga

SEQ ID NO: 25231 - DNA, 20 bp, synthetic construct
  source 1..20: mol_type = other DNA
gagaaggacttggtcaagac

SEQ ID NO: 25232 - DNA, 20 bp, synthetic construct
  source 1..20: mol_type = other DNA
tccatgaatcaaccttgaag

SEQ ID NO: 25233 - DNA, 20 bp, synthetic construct
  source 1..20: mol_type = other DNA
tttgacatgaggataagaac

SEQ ID NO: 25234 - DNA, 20 bp, synthetic construct
  source 1..20: mol_type = other DNA
gactaccgaaacatatatac

SEQ ID NO: 25235 - DNA, 20 bp, synthetic construct
  source 1..20: mol_type = other DNA
gagggcgactaaatagaggg

SEQ ID NO: 25236 - DNA, 20 bp, synthetic construct
  source 1..20: mol_type = other DNA
aggaggctattcaaggccat

SEQ ID NO: 25237 - DNA, 20 bp, synthetic construct
  source 1..20: mol_type = other DNA
acaaagcaggagattattta

SEQ ID NO: 25238 - DNA, 20 bp, synthetic construct
  source 1..20: mol_type = other DNA
ataaatttgctacaaaaagg

SEQ ID NO: 25239 - DNA, 20 bp, synthetic construct
  source 1..20: mol_type = other DNA
catatccaacacgcaatgtt

SEQ ID NO: 25240 - DNA, 20 bp, synthetic construct
  source 1..20: mol_type = other DNA
cacatggagtctctctcgaa

SEQ ID NO: 25241 - DNA, 20 bp, synthetic construct
  source 1..20: mol_type = other DNA
gtgacaatcaatgtataact

SEQ ID NO: 25242 - DNA, 20 bp, synthetic construct
  source 1..20: mol_type = other DNA
tttattttggcaaaaaacaa

SEQ ID NO: 25243 - DNA, 20 bp, synthetic construct
  source 1..20: mol_type = other DNA
atgagcattgccctaaatgt

SEQ ID NO: 25244 - DNA, 20 bp, synthetic construct
  source 1..20: mol_type = other DNA
attttgctgttgcacttttt

SEQ ID NO: 25245 - DNA, 20 bp, synthetic construct
  source 1..20: mol_type = other DNA
acaattcatcaacggatcca

SEQ ID NO: 25246 - DNA, 20 bp, synthetic construct
  source 1..20: mol_type = other DNA
tagctactcaaatacataat

SEQ ID NO: 25247 - DNA, 20 bp, synthetic construct
  source 1..20: mol_type = other DNA
cagagattgtaaggcttact

SEQ ID NO: 25248 - DNA, 20 bp, synthetic construct
  source 1..20: mol_type = other DNA
ttaccgatattactaatcca

SEQ ID NO: 25249 - DNA, 20 bp, synthetic construct
  source 1..20: mol_type = other DNA
agttctttctaataatacaa

SEQ ID NO: 25250 - DNA, 20 bp, synthetic construct
  source 1..20: mol_type = other DNA
tcaaactaatagatagattg

SEQ ID NO: 25251 - DNA, 20 bp, synthetic construct
  source 1..20: mol_type = other DNA
gagcctgcagaacacgcagg

SEQ ID NO: 25252 - DNA, 20 bp, synthetic construct
  source 1..20: mol_type = other DNA
tcatttgctagtctgtttct

SEQ ID NO: 25253 - DNA, 20 bp, synthetic construct
  source 1..20: mol_type = other DNA
gcgcgaacagccaaagtcaa

SEQ ID NO: 25254 - DNA, 20 bp, synthetic construct
  source 1..20: mol_type = other DNA
gagcccatcattttcagcac

SEQ ID NO: 25255 - DNA, 20 bp, synthetic construct
  source 1..20: mol_type = other DNA
ctttccagcaccggatgtaa

SEQ ID NO: 25256 - DNA, 20 bp, synthetic construct
  source 1..20: mol_type = other DNA
aataggaaatcaagccttct

SEQ ID NO: 25257 - DNA, 20 bp, synthetic construct
  source 1..20: mol_type = other DNA
tcatcccaaactgagaccta

SEQ ID NO: 25258 - DNA, 20 bp, synthetic construct
  source 1..20: mol_type = other DNA
ctgccgcagcatatagaccc

SEQ ID NO: 25259 - DNA, 20 bp, synthetic construct
  source 1..20: mol_type = other DNA
ccacaaagaaggcgctttct

SEQ ID NO: 25260 - DNA, 20 bp, synthetic construct
  source 1..20: mol_type = other DNA
accagcttcgccaacaacca

SEQ ID NO: 25261 - DNA, 20 bp, synthetic construct
  source 1..20: mol_type = other DNA
cagctagcaaatgagacgac

SEQ ID NO: 25262 - DNA, 20 bp, synthetic construct
  source 1..20: mol_type = other DNA
gctaggacaggatcaatcag

SEQ ID NO: 25263 - DNA, 20 bp, synthetic construct
  source 1..20: mol_type = other DNA
gcaaccgtaataaaagcatt

SEQ ID NO: 25264 - DNA, 20 bp, synthetic construct
  source 1..20: mol_type = other DNA
aacaagttctcaactaagag

SEQ ID NO: 25265 - DNA, 20 bp, synthetic construct
  source 1..20: mol_type = other DNA
aatgtccctgggtcacaaga

SEQ ID NO: 25266 - DNA, 20 bp, synthetic construct
  source 1..20: mol_type = other DNA
tattcagggaacatcgtaca

SEQ ID NO: 25267 - DNA, 20 bp, synthetic construct
  source 1..20: mol_type = other DNA
ttaacaactcaaatccataa

SEQ ID NO: 25268 - DNA, 20 bp, synthetic construct
  source 1..20: mol_type = other DNA
gtggccatttcttccttcct

SEQ ID NO: 25269 - DNA, 20 bp, synthetic construct
  source 1..20: mol_type = other DNA
ttccaagaagacagaaataa

SEQ ID NO: 25270 - DNA, 20 bp, synthetic construct
  source 1..20: mol_type = other DNA
gcaaaattaatggagagatt

SEQ ID NO: 25271 - DNA, 20 bp, synthetic construct
  source 1..20: mol_type = other DNA
caatgcgtaatttataccga

SEQ ID NO: 25272 - DNA, 20 bp, synthetic construct
  source 1..20: mol_type = other DNA
tctctcccgtttggctccac

SEQ ID NO: 25273 - DNA, 20 bp, synthetic construct
  source 1..20: mol_type = other DNA
gctgcctgggccttccacgc

SEQ ID NO: 25274 - DNA, 20 bp, synthetic construct
  source 1..20: mol_type = other DNA
cccgaccctatcttcgctga

SEQ ID NO: 25275 - DNA, 20 bp, synthetic construct
  source 1..20: mol_type = other DNA
gggccttccaactcctcccg

SEQ ID NO: 25276 - DNA, 20 bp, synthetic construct
  source 1..20: mol_type = other DNA
ctcaacttcccttactccat

SEQ ID NO: 25277 - DNA, 20 bp, synthetic construct
  source 1..20: mol_type = other DNA
acccctcaatccgcaaccca

SEQ ID NO: 25278 - DNA, 20 bp, synthetic construct
  source 1..20: mol_type = other DNA
ccctctttcctggacgtctc

SEQ ID NO: 25279 - DNA, 20 bp, synthetic construct
  source 1..20: mol_type = other DNA
cccctaggccaaacccttac

SEQ ID NO: 25280 - DNA, 20 bp, synthetic construct
  source 1..20: mol_type = other DNA
gacctcaccacctccgcctc

SEQ ID NO: 25281 - DNA, 20 bp, synthetic construct
  source 1..20: mol_type = other DNA
accattgccgtgttcatccg

SEQ ID NO: 25282 - DNA, 20 bp, synthetic construct
  source 1..20: mol_type = other DNA
gaggatcgtgctcacgtcac

SEQ ID NO: 25283 - DNA, 20 bp, synthetic construct
  source 1..20: mol_type = other DNA
aaccagcggctaacgtatgt

SEQ ID NO: 25284 - DNA, 20 bp, synthetic construct
  source 1..20: mol_type = other DNA
agcgagtacccctactccgc

SEQ ID NO: 25285 - DNA, 20 bp, synthetic construct
  source 1..20: mol_type = other DNA
gtcgtgatcgcctccgactt

SEQ ID NO: 25286 - DNA, 20 bp, synthetic construct
  source 1..20: mol_type = other DNA
agtcacgacaccatcatggc

SEQ ID NO: 25287 - DNA, 20 bp, synthetic construct
  source 1..20: mol_type = other DNA
ctgatcccgggcgtcaagcc

SEQ ID NO: 25288 - DNA, 20 bp, synthetic construct
  source 1..20: mol_type = other DNA
gacatccgtcgctttatccg

SEQ ID NO: 25289 - DNA, 20 bp, synthetic construct
  source 1..20: mol_type = other DNA
tggcccaccctccccgttgc

SEQ ID NO: 25290 - DNA, 20 bp, synthetic construct
  source 1..20: mol_type = other DNA
gcgatcatcgctggacgcat

SEQ ID NO: 25291 - DNA, 20 bp, synthetic construct
  source 1..20: mol_type = other DNA
actctcccctcctgcgcttt

SEQ ID NO: 25292 - DNA, 20 bp, synthetic construct
  source 1..20: mol_type = other DNA
gttggaacctcaatcctcaa

SEQ ID NO: 25293 - DNA, 20 bp, synthetic construct
  source 1..20: mol_type = other DNA
aacaccaccctaatcgtgac

SEQ ID NO: 25294 - DNA, 20 bp, synthetic construct
  source 1..20: mol_type = other DNA
tcttaagtctgtgccttcca

SEQ ID NO: 25295 - DNA, 20 bp, synthetic construct
  source 1..20: mol_type = other DNA
atggtaagtgatcaattcac

SEQ ID NO: 25296 - DNA, 20 bp, synthetic construct
  source 1..20: mol_type = other DNA
ctcgaagttctcggggttct

SEQ ID NO: 25297 - DNA, 20 bp, synthetic construct
  source 1..20: mol_type = other DNA
atctggaaaccggaattgcg

SEQ ID NO: 25298 - DNA, 20 bp, synthetic construct
  source 1..20: mol_type = other DNA
acctgaaacaggcactaaat

SEQ ID NO: 25299 - DNA, 20 bp, synthetic construct
  source 1..20: mol_type = other DNA
ggggtaccctggtggtagct

SEQ ID NO: 25300 - DNA, 20 bp, synthetic construct
  source 1..20: mol_type = other DNA
gagtccttgattttccacca

SEQ ID NO: 25301 - DNA, 20 bp, synthetic construct
  source 1..20: mol_type = other DNA
tgactggagttttccttatc

SEQ ID NO: 25302 - DNA, 20 bp, synthetic construct
  source 1..20: mol_type = other DNA
aaggtcctagtgggcaggct

SEQ ID NO: 25303 - DNA, 20 bp, synthetic construct
  source 1..20: mol_type = other DNA
aaaattctttgcagcgcact

SEQ ID NO: 25304 - DNA, 20 bp, synthetic construct
  source 1..20: mol_type = other DNA
taactgctaattttaatctt

SEQ ID NO: 25305 - DNA, 20 bp, synthetic construct
  source 1..20: mol_type = other DNA
tagatggtgttgtgttagat

SEQ ID NO: 25306 - DNA, 20 bp, synthetic construct
  source 1..20: mol_type = other DNA
atgagctgaggaaagttgag

SEQ ID NO: 25307 - DNA, 20 bp, synthetic construct
  source 1..20: mol_type = other DNA
tgtatggaaacaagatttat

SEQ ID NO: 25308 - DNA, 20 bp, synthetic construct
  source 1..20: mol_type = other DNA
tccgtccaagccgcggacgt

SEQ ID NO: 25309 - DNA, 20 bp, synthetic construct
  source 1..20: mol_type = other DNA
gcgacagttccggtcaactc

SEQ ID NO: 25310 - DNA, 20 bp, synthetic construct
  source 1..20: mol_type = other DNA
agatgtggctgggaagtgtt

SEQ ID NO: 25311 - DNA, 20 bp, synthetic construct
  source 1..20: mol_type = other DNA
ctgctcttgccatatgcttc

SEQ ID NO: 25312 - DNA, 20 bp, synthetic construct
  source 1..20: mol_type = other DNA
aatttgctggtccgtcctct

SEQ ID NO: 25313 - DNA, 20 bp, synthetic construct
  source 1..20: mol_type = other DNA
gtgattcctttttgcagctc

SEQ ID NO: 25314 - DNA, 20 bp, synthetic construct
  source 1..20: mol_type = other DNA
ttcctggatatgttattaga

SEQ ID NO: 25315 - DNA, 20 bp, synthetic construct
  source 1..20: mol_type = other DNA
aagctggaccgcatctctga

SEQ ID NO: 25316 - DNA, 20 bp, synthetic construct
  source 1..20: mol_type = other DNA
aaggtcgatgacatctatgc

SEQ ID NO: 25317 - DNA, 20 bp, synthetic construct
  source 1..20: mol_type = other DNA
atgagacatttcaaatctgg

SEQ ID NO: 25318 - DNA, 20 bp, synthetic construct
  source 1..20: mol_type = other DNA
gatgtgaagatgacccgcat

SEQ ID NO: 25319 - DNA, 20 bp, synthetic construct
  source 1..20: mol_type = other DNA
acgttccgtggaattgaaac

SEQ ID NO: 25320 - DNA, 20 bp, synthetic construct
  source 1..20: mol_type = other DNA
gggactcccctgctggatgg

SEQ ID NO: 25321 - DNA, 20 bp, synthetic construct
  source 1..20: mol_type = other DNA
ggtgatgatgtagtttatgc

SEQ ID NO: 25322 - DNA, 20 bp, synthetic construct
  source 1..20: mol_type = other DNA
ggagttcgcaaatctgctgc

SEQ ID NO: 25323 - DNA, 20 bp, synthetic construct
  source 1..20: mol_type = other DNA
tttgtcattgctacttctaa

SEQ ID NO: 25324 - DNA, 20 bp, synthetic construct
  source 1..20: mol_type = other DNA
cctattgctgcttgtgctta

SEQ ID NO: 25325 - DNA, 20 bp, synthetic construct
  source 1..20: mol_type = other DNA
atgttagaatcccatcagga

SEQ ID NO: 25326 - DNA, 20 bp, synthetic construct
  source 1..20: mol_type = other DNA
tcatcaaatgatcataatgc

SEQ ID NO: 25327 - DNA, 20 bp, synthetic construct
  source 1..20: mol_type = other DNA
ggcattgttgatactgagct

SEQ ID NO: 25328 - DNA, 20 bp, synthetic construct
  source 1..20: mol_type = other DNA
gtagacaatgagataggttt

SEQ ID NO: 25329 - DNA, 20 bp, synthetic construct
  source 1..20: mol_type = other DNA
cttcttgctcacgaggaaaa

SEQ ID NO: 25330 - DNA, 20 bp, synthetic construct
  source 1..20: mol_type = other DNA
gatgaaaccaagagtggttc

SEQ ID NO: 25331 - DNA, 20 bp, synthetic construct
  source 1..20: mol_type = other DNA
gattccgagcttctaagctt

SEQ ID NO: 25332 - DNA, 20 bp, synthetic construct
  source 1..20: mol_type = other DNA
ttggcagccaggttttaact

SEQ ID NO: 25333 - DNA, 20 bp, synthetic construct
  source 1..20: mol_type = other DNA
catcaattagacaaatttct

SEQ ID NO: 25334 - DNA, 20 bp, synthetic construct
  source 1..20: mol_type = other DNA
aaacttctaagattcgttcc

SEQ ID NO: 25335 - DNA, 20 bp, synthetic construct
  source 1..20: mol_type = other DNA
atattcctgctaagggtttc

SEQ ID NO: 25336 - DNA, 20 bp, synthetic construct
  source 1..20: mol_type = other DNA
gtggaaatactccctcgccg

SEQ ID NO: 25337 - DNA, 20 bp, synthetic construct
  source 1..20: mol_type = other DNA
agttcgcaaagacacaatac

SEQ ID NO: 25338 - DNA, 20 bp, synthetic construct
  source 1..20: mol_type = other DNA
cttatgatcctgccactgaa

SEQ ID NO: 25339 - DNA, 20 bp, synthetic construct
  source 1..20: mol_type = other DNA
cgataacagaggatcctact

SEQ ID NO: 25340 - DNA, 20 bp, synthetic construct
  source 1..20: mol_type = other DNA
atgtggagcttgatcctgct

SEQ ID NO: 25341 - DNA, 20 bp, synthetic construct
  source 1..20: mol_type = other DNA
taacccgtcgcgagacgcgt

SEQ ID NO: 25342 - DNA, 20 bp, synthetic construct
  source 1..20: mol_type = other DNA
cctaggtttacttttattag

SEQ ID NO: 25343 - DNA, 20 bp, synthetic construct
  source 1..20: mol_type = other DNA
tccgctgtcttggggtatgg

SEQ ID NO: 25344 - DNA, 20 bp, synthetic construct
  source 1..20: mol_type = other DNA
tgacactatatccgcaccaa

SEQ ID NO: 25345 - DNA, 20 bp, synthetic construct
  source 1..20: mol_type = other DNA
taccaggtaggatgacaaat

SEQ ID NO: 25346 - DNA, 20 bp, synthetic construct
  source 1..20: mol_type = other DNA
ggttgcaatcaacgtgtacg

SEQ ID NO: 25347 - DNA, 20 bp, synthetic construct
  source 1..20: mol_type = other DNA
gtattgctgccatcctggaa

SEQ ID NO: 25348 - DNA, 20 bp, synthetic construct
  source 1..20: mol_type = other DNA
tcacagccatcacacgatct

SEQ ID NO: 25349 - DNA, 20 bp, synthetic construct
  source 1..20: mol_type = other DNA
ttggactgcttattcatggg

SEQ ID NO: 25350 - DNA, 20 bp, synthetic construct
  source 1..20: mol_type = other DNA
aaaacccggatggtgaggac

SEQ ID NO: 25351 - DNA, 20 bp, synthetic construct
  source 1..20: mol_type = other DNA
aatcattacctgcaaaccca

SEQ ID NO: 25352 - DNA, 20 bp, synthetic construct
  source 1..20: mol_type = other DNA
acgctgcccaactccagccc

SEQ ID NO: 25353 - DNA, 20 bp, synthetic construct
  source 1..20: mol_type = other DNA
taggttttgacacggaagat

SEQ ID NO: 25354 - DNA, 20 bp, synthetic construct
  source 1..20: mol_type = other DNA
acaagtttattgccctggtt

SEQ ID NO: 25355 - DNA, 20 bp, synthetic construct
  source 1..20: mol_type = other DNA
cggaaggcgaaacgtcgggg

SEQ ID NO: 25356 - DNA, 20 bp, synthetic construct
  source 1..20: mol_type = other DNA
aacgtgcatcaccatggaga

SEQ ID NO: 25357 - DNA, 20 bp, synthetic construct
  source 1..20: mol_type = other DNA
ataattttcacaattatgtt

SEQ ID NO: 25358 - DNA, 20 bp, synthetic construct
  source 1..20: mol_type = other DNA
aagatgatgaacatggaggc

SEQ ID NO: 25359 - DNA, 20 bp, synthetic construct
  source 1..20: mol_type = other DNA
tttcatgatctcaacttacc

SEQ ID NO: 25360 - DNA, 20 bp, synthetic construct
  source 1..20: mol_type = other DNA
gggccctgtagagttcccat

SEQ ID NO: 25361 - DNA, 20 bp, synthetic construct
  source 1..20: mol_type = other DNA
tttaaaagcttatttggagg

SEQ ID NO: 25362 - DNA, 20 bp, synthetic construct
  source 1..20: mol_type = other DNA
gacttggctaggaaagaatt

SEQ ID NO: 25363 - DNA, 20 bp, synthetic construct
  source 1..20: mol_type = other DNA
cacaacatgtgggtaagcat

SEQ ID NO: 25364 - DNA, 20 bp, synthetic construct
  source 1..20: mol_type = other DNA
accgcagtaatgggcacagc

SEQ ID NO: 25365 - DNA, 20 bp, synthetic construct
  source 1..20: mol_type = other DNA
gtggcagctgcatttgctga

SEQ ID NO: 25366 - DNA, 20 bp, synthetic construct
  source 1..20: mol_type = other DNA
ctgggaatcctctcactatt

SEQ ID NO: 25367 - DNA, 20 bp, synthetic construct
  source 1..20: mol_type = other DNA
gcgagggtgactggagcatc

SEQ ID NO: 25368 - DNA, 20 bp, synthetic construct
  source 1..20: mol_type = other DNA
cacgtgacgaatggggccgt

SEQ ID NO: 25369 - DNA, 20 bp, synthetic construct
  source 1..20: mol_type = other DNA
attatggatgaggctcactt

SEQ ID NO: 25370 - DNA, 20 bp, synthetic construct
  source 1..20: mol_type = other DNA
aagagtggagaatgggattt

SEQ ID NO: 25371 - DNA, 20 bp, synthetic construct
  source 1..20: mol_type = other DNA
cagcgtcgtggacgggttgg

SEQ ID NO: 25372 - DNA, 20 bp, synthetic construct
  source 1..20: mol_type = other DNA
ccagcgacggcatgggcggc

SEQ ID NO: 25373 - DNA, 20 bp, synthetic construct
  source 1..20: mol_type = other DNA
tggaactatcatggaagcta

SEQ ID NO: 25374 - DNA, 20 bp, synthetic construct
  source 1..20: mol_type = other DNA
gtacccttttgctcacacca

SEQ ID NO: 25375 - DNA, 20 bp, synthetic construct
  source 1..20: mol_type = other DNA
ttgatgtacttccacaggag

SEQ ID NO: 25376 - DNA, 20 bp, synthetic construct
  source 1..20: mol_type = other DNA
aatccctgccaccggatgtt

SEQ ID NO: 25377 - DNA, 20 bp, synthetic construct
  source 1..20: mol_type = other DNA
aggggaaggactagaggtta

SEQ ID NO: 25378 - DNA, 20 bp, synthetic construct
  source 1..20: mol_type = other DNA
ctcaatgtctttatttacac

SEQ ID NO: 25379 - DNA, 20 bp, synthetic construct
  source 1..20: mol_type = other DNA
aactactatggtgcccaata

SEQ ID NO: 25380 - DNA, 20 bp, synthetic construct
  source 1..20: mol_type = other DNA
ggcaactccactcttacaac

SEQ ID NO: 25381 - DNA, 20 bp, synthetic construct
  source 1..20: mol_type = other DNA
cgcgtgattcgcttgcctgg

SEQ ID NO: 25382 - DNA, 20 bp, synthetic construct
  source 1..20: mol_type = other DNA
tctctatacattgttccaat

SEQ ID NO: 25383 - DNA, 20 bp, synthetic construct
  source 1..20: mol_type = other DNA
actatcaagaacgatggttt

SEQ ID NO: 25384 - DNA, 20 bp, synthetic construct
  source 1..20: mol_type = other DNA
ggagatgccccagcaacacg

SEQ ID NO: 25385 - DNA, 20 bp, synthetic construct
  source 1..20: mol_type = other DNA
caaaccaatatagttgttcc

SEQ ID NO: 25386 - DNA, 20 bp, synthetic construct
  source 1..20: mol_type = other DNA
gtacttcgccccgctacagg

SEQ ID NO: 25387 - DNA, 20 bp, synthetic construct
  source 1..20: mol_type = other DNA
atcgaggcatttatgtctcg

SEQ ID NO: 25388 - DNA, 20 bp, synthetic construct
  source 1..20: mol_type = other DNA
gatgtggtcgctattgtctc

SEQ ID NO: 25389 - DNA, 20 bp, synthetic construct
  source 1..20: mol_type = other DNA
cccccggcatccctacggct

SEQ ID NO: 25390 - DNA, 20 bp, synthetic construct
  source 1..20: mol_type = other DNA
caccttttcaacaacagact

SEQ ID NO: 25391 - DNA, 20 bp, synthetic construct
  source 1..20: mol_type = other DNA
gctatggccacagcaggcag

SEQ ID NO: 25392 - DNA, 20 bp, synthetic construct
  source 1..20: mol_type = other DNA
tacggggtgcagcgaaacca

SEQ ID NO: 25393 - DNA, 20 bp, synthetic construct
  source 1..20: mol_type = other DNA
cagaagttgggtggcaacag

SEQ ID NO: 25394 - DNA, 20 bp, synthetic construct
  source 1..20: mol_type = other DNA
aacactgcacttgacaggtg

SEQ ID NO: 25395 - DNA, 20 bp, synthetic construct
  source 1..20: mol_type = other DNA
aagctcgaggcaatcttcca

SEQ ID NO: 25396 - DNA, 20 bp, synthetic construct
  source 1..20: mol_type = other DNA
tccatcttgtcatccctcac

SEQ ID NO: 25397 - DNA, 20 bp, synthetic construct
  source 1..20: mol_type = other DNA
ggtaacacagacattcccat

SEQ ID NO: 25398 - DNA, 20 bp, synthetic construct
  source 1..20: mol_type = other DNA
tatgtcattaagaacaccag

SEQ ID NO: 25399 - DNA, 20 bp, synthetic construct
  source 1..20: mol_type = other DNA
tgcagttccatgaatgacac

SEQ ID NO: 25400 - DNA, 20 bp, synthetic construct
  source 1..20: mol_type = other DNA
gggacatccatcttcaattc

SEQ ID NO: 25401 - DNA, 20 bp, synthetic construct
  source 1..20: mol_type = other DNA
tacaatttgacaatgacacc

SEQ ID NO: 25402 - DNA, 20 bp, synthetic construct
  source 1..20: mol_type = other DNA
cctggtaacaggtgccccag

SEQ ID NO: 25403 - DNA, 20 bp, synthetic construct
  source 1..20: mol_type = other DNA
taccccctaccccgctcacc

SEQ ID NO: 25404 - DNA, 20 bp, synthetic construct
  source 1..20: mol_type = other DNA
cccgcacagatgcccctcgc

SEQ ID NO: 25405 - DNA, 20 bp, synthetic construct
  source 1..20: mol_type = other DNA
ggtcgctccgggggtgcgtc

SEQ ID NO: 25406 - DNA, 20 bp, synthetic construct
  source 1..20: mol_type = other DNA
aattggggcactcaatctgg

SEQ ID NO: 25407 - DNA, 20 bp, synthetic construct
  source 1..20: mol_type = other DNA
atcctttacatggtcccgga

SEQ ID NO: 25408 - DNA, 20 bp, synthetic construct
  source 1..20: mol_type = other DNA
tccccttctgccattgctgg

SEQ ID NO: 25409 - DNA, 20 bp, synthetic construct
  source 1..20: mol_type = other DNA
gatgtctccggcctcactgc

SEQ ID NO: 25410 - DNA, 20 bp, synthetic construct
  source 1..20: mol_type = other DNA
cttggtgacgtcccaccaga

SEQ ID NO: 25411 - DNA, 20 bp, synthetic construct
  source 1..20: mol_type = other DNA
cgggaagtcccactctcctc

SEQ ID NO: 25412 - DNA, 20 bp, synthetic construct
  source 1..20: mol_type = other DNA
ctctttggttccccctcccc

SEQ ID NO: 25413 - DNA, 20 bp, synthetic construct
  source 1..20: mol_type = other DNA
tctcaacaccgcaagcgcca

SEQ ID NO: 25414 - DNA, 20 bp, synthetic construct
  source 1..20: mol_type = other DNA
acctccaacttccatgagcc

SEQ ID NO: 25415 - DNA, 20 bp, synthetic construct
  source 1..20: mol_type = other DNA
acccttttccaagccaacgt

SEQ ID NO: 25416 - DNA, 20 bp, synthetic construct
  source 1..20: mol_type = other DNA
actccccgggaaatccccga

SEQ ID NO: 25417 - DNA, 20 bp, synthetic construct
  source 1..20: mol_type = other DNA
ttcctggcggtggtcggatt

SEQ ID NO: 25418 - DNA, 20 bp, synthetic construct
  source 1..20: mol_type = other DNA
atctctcccgcaatccctgg

SEQ ID NO: 25419 - DNA, 20 bp, synthetic construct
  source 1..20: mol_type = other DNA
tgggccaccctccctaccct

SEQ ID NO: 25420 - DNA, 20 bp, synthetic construct
  source 1..20: mol_type = other DNA
cttgacatgaacttccccgg

SEQ ID NO: 25421 - DNA, 20 bp, synthetic construct
  source 1..20: mol_type = other DNA
cataccattctccctgaaat

SEQ ID NO: 25422 - DNA, 20 bp, synthetic construct
  source 1..20: mol_type = other DNA
atggaagggcttgatatggg

SEQ ID NO: 25423 - DNA, 20 bp, synthetic construct
  source 1..20: mol_type = other DNA
tggaccgagttcttctacaa

SEQ ID NO: 25424 - DNA, 20 bp, synthetic construct
  source 1..20: mol_type = other DNA
cacatctatggcaaccagat

SEQ ID NO: 25425 - DNA, 20 bp, synthetic construct
  source 1..20: mol_type = other DNA
tacgcgacggaacccccaat

SEQ ID NO: 25426 - DNA, 20 bp, synthetic construct
  source 1..20: mol_type = other DNA
attcaccctgtgatggaccc

SEQ ID NO: 25427 - DNA, 20 bp, synthetic construct
  source 1..20: mol_type = other DNA
ccaaatttcctcccctactc

SEQ ID NO: 25428 - DNA, 20 bp, synthetic construct
  source 1..20: mol_type = other DNA
ccatggttgtactgtgctat

SEQ ID NO: 25429 - DNA, 20 bp, synthetic construct
  source 1..20: mol_type = other DNA
acttacctttttcccctctt

SEQ ID NO: 25430 - DNA, 20 bp, synthetic construct
  source 1..20: mol_type = other DNA
cgacaggttatggtagagta

SEQ ID NO: 25431 - DNA, 20 bp, synthetic construct
  source 1..20: mol_type = other DNA
gccattggattatgtcaccg

SEQ ID NO: 25432 - DNA, 20 bp, synthetic construct
  source 1..20: mol_type = other DNA
aaatgctgccatagcccatt

SEQ ID NO: 25433 - DNA, 20 bp, synthetic construct
  source 1..20: mol_type = other DNA
cggcggttcggcgccagcca

SEQ ID NO: 25434 - DNA, 20 bp, synthetic construct
  source 1..20: mol_type = other DNA
acatgccctgcagcccctag

SEQ ID NO: 25435 - DNA, 20 bp, synthetic construct
  source 1..20: mol_type = other DNA
catttctttgcgacttccct

SEQ ID NO: 25436 - DNA, 20 bp, synthetic construct
  source 1..20: mol_type = other DNA
acatcgcattttgatgcttg

SEQ ID NO: 25437 - DNA, 20 bp, synthetic construct
  source 1..20: mol_type = other DNA
agcagcaaattgtgggcccc

SEQ ID NO: 25438 - DNA, 20 bp, synthetic construct
  source 1..20: mol_type = other DNA
ttatgttgctgatcttgtgt

SEQ ID NO: 25439 - DNA, 20 bp, synthetic construct
  source 1..20: mol_type = other DNA
gggtcacagctttggtgatt

SEQ ID NO: 25440 - DNA, 20 bp, synthetic construct
  source 1..20: mol_type = other DNA
gcttgtccatggcacacctg

SEQ ID NO: 25441 - DNA, 20 bp, synthetic construct
  source 1..20: mol_type = other DNA
tagattttttgtggatgtta

SEQ ID NO: 25442 - DNA, 20 bp, synthetic construct
  source 1..20: mol_type = other DNA
tgaagaattgagaaaggaag

SEQ ID NO: 25443 - DNA, 20 bp, synthetic construct
  source 1..20: mol_type = other DNA
tgtcaataagctgttcaagc

SEQ ID NO: 25444 - DNA, 20 bp, synthetic construct
  source 1..20: mol_type = other DNA
gaagtcaaggctgattgagt

SEQ ID NO: 25445 - DNA, 20 bp, synthetic construct
  source 1..20: mol_type = other DNA
ctttccaatgaaggaaattt

SEQ ID NO: 25446 - DNA, 20 bp, synthetic construct
  source 1..20: mol_type = other DNA
gtacagtgtactgcgccagc

SEQ ID NO: 25447 - DNA, 20 bp, synthetic construct
  source 1..20: mol_type = other DNA
actgtgggcgacaggttatg

SEQ ID NO: 25448 - DNA, 20 bp, synthetic construct
  source 1..20: mol_type = other DNA
taacctgtatagtcagttga

SEQ ID NO: 25449 - DNA, 20 bp, synthetic construct
  source 1..20: mol_type = other DNA
tgcgtcggctcatggtgctg

SEQ ID NO: 25450 - DNA, 20 bp, synthetic construct
  source 1..20: mol_type = other DNA
tcttacagacttaggagttt

SEQ ID NO: 25451 - DNA, 20 bp, synthetic construct
  source 1..20: mol_type = other DNA
ggaagcaaaagatcttgaag

SEQ ID NO: 25452 - DNA, 20 bp, synthetic construct
  source 1..20: mol_type = other DNA
ggagctttcatatatgaatg

SEQ ID NO: 25453 - DNA, 20 bp, synthetic construct
  source 1..20: mol_type = other DNA
ggggtttcctattttaccgg

SEQ ID NO: 25454 - DNA, 20 bp, synthetic construct
  source 1..20: mol_type = other DNA
agctcccgccacacgcaaag

SEQ ID NO: 25455 - DNA, 20 bp, synthetic construct
  source 1..20: mol_type = other DNA
agttacatctgtaaatggtt

SEQ ID NO: 25456 - DNA, 20 bp, synthetic construct
  source 1..20: mol_type = other DNA
gaggacaaatggtgcttatc

SEQ ID NO: 25457 - DNA, 20 bp, synthetic construct
  source 1..20: mol_type = other DNA
tgttgcaatccgctgtgggg

SEQ ID NO: 25458 - DNA, 20 bp, synthetic construct
  source 1..20: mol_type = other DNA
taagtcattagtgacagaag

SEQ ID NO: 25459 - DNA, 20 bp, synthetic construct
  source 1..20: mol_type = other DNA
tcaaatggtatcctcaacag

SEQ ID NO: 25460 - DNA, 20 bp, synthetic construct
  source 1..20: mol_type = other DNA
accctcaaaggattacctta

SEQ ID NO: 25461 - DNA, 20 bp, synthetic construct
  source 1..20: mol_type = other DNA
ttctgttaagactaagaagg

SEQ ID NO: 25462 - DNA, 20 bp, synthetic construct
  source 1..20: mol_type = other DNA
gaatgataccatcctgatga

SEQ ID NO: 25463 - DNA, 20 bp, synthetic construct
  source 1..20: mol_type = other DNA
atccattcgctggtgcaagt

SEQ ID NO: 25464 - DNA, 20 bp, synthetic construct
  source 1..20: mol_type = other DNA
ggtcgcgtatggttgttggc

SEQ ID NO: 25465 - DNA, 20 bp, synthetic construct
  source 1..20: mol_type = other DNA
cgagtatagttcaggggcta

SEQ ID NO: 25466 - DNA, 20 bp, synthetic construct
  source 1..20: mol_type = other DNA
gtacccggagtaccagaaga

SEQ ID NO: 25467 - DNA, 20 bp, synthetic construct
  source 1..20: mol_type = other DNA
acagggtaatttattatccc

SEQ ID NO: 25468 - DNA, 20 bp, synthetic construct
  source 1..20: mol_type = other DNA
tcccaatcagtgtgcgcttg

SEQ ID NO: 25469 - DNA, 20 bp, synthetic construct
  source 1..20: mol_type = other DNA
gtcactaccacaacagctct

SEQ ID NO: 25470 - DNA, 20 bp, synthetic construct
  source 1..20: mol_type = other DNA
gggcatctcgtccgcttatg

SEQ ID NO: 25471 - DNA, 20 bp, synthetic construct
  source 1..20: mol_type = other DNA
ctgccggccagtcaattttg

SEQ ID NO: 25472 - DNA, 20 bp, synthetic construct
  source 1..20: mol_type = other DNA
ctccgagtacaaaccagtgt

SEQ ID NO: 25473 - DNA, 20 bp, synthetic construct
  source 1..20: mol_type = other DNA
gtctgagataccgtattttc

SEQ ID NO: 25474 - DNA, 20 bp, synthetic construct
  source 1..20: mol_type = other DNA
gaccacgatcaccacccttg

SEQ ID NO: 25475 - DNA, 20 bp, synthetic construct
  source 1..20: mol_type = other DNA
gcttatggagacctttgata

SEQ ID NO: 25476 - DNA, 20 bp, synthetic construct
  source 1..20: mol_type = other DNA
atgtggaaaggccgtgaaac

SEQ ID NO: 25477 - DNA, 20 bp, synthetic construct
  source 1..20: mol_type = other DNA
acaaaagatgaaggtaaaac

SEQ ID NO: 25478 - DNA, 20 bp, synthetic construct
  source 1..20: mol_type = other DNA
aaccctcgcctccttcatat

SEQ ID NO: 25479 - DNA, 20 bp, synthetic construct
  source 1..20: mol_type = other DNA
caaccgtcccaccaaattca

SEQ ID NO: 25480 - DNA, 20 bp, synthetic construct
  source 1..20: mol_type = other DNA
aaggcctatcaacctcaaca

SEQ ID NO: 25481 - DNA, 20 bp, synthetic construct
  source 1..20: mol_type = other DNA
agagctgtccctggctgtgg

SEQ ID NO: 25482 - DNA, 20 bp, synthetic construct
  source 1..20: mol_type = other DNA
caacaacctcattatcaaga

SEQ ID NO: 25483 - DNA, 20 bp, synthetic construct
  source 1..20: mol_type = other DNA
ctttgtcattgcccacctac

SEQ ID NO: 25484 - DNA, 20 bp, synthetic construct
  source 1..20: mol_type = other DNA
atggtgcactacatgatacg

SEQ ID NO: 25485 - DNA, 20 bp, synthetic construct
  source 1..20: mol_type = other DNA
gccgaagatgtattgtgacc

SEQ ID NO: 25486 - DNA, 20 bp, synthetic construct
  source 1..20: mol_type = other DNA
atgtgatgcacatctaggat

SEQ ID NO: 25487 - DNA, 20 bp, synthetic construct
  source 1..20: mol_type = other DNA
ccaaaacttggatccagcag

SEQ ID NO: 25488 - DNA, 20 bp, synthetic construct
  source 1..20: mol_type = other DNA
gtgtctacccaaaatccatt

SEQ ID NO: 25489 - DNA, 20 bp, synthetic construct
  source 1..20: mol_type = other DNA
acaatgggcaacatccctta

SEQ ID NO: 25490 - DNA, 20 bp, synthetic construct
  source 1..20: mol_type = other DNA
accggaagatgacaatcatg

SEQ ID NO: 25491 - DNA, 20 bp, synthetic construct
  source 1..20: mol_type = other DNA
aatgaagcaccaggaaacta

SEQ ID NO: 25492 - DNA, 20 bp, synthetic construct
  source 1..20: mol_type = other DNA
ctcgctcccacctgatccaa

SEQ ID NO: 25493 - DNA, 20 bp, synthetic construct
  source 1..20: mol_type = other DNA
tattagtgattttgttctag

SEQ ID NO: 25494 - DNA, 20 bp, synthetic construct
  source 1..20: mol_type = other DNA
tcatgaggtggatgtgcttt

SEQ ID NO: 25495 - DNA, 20 bp, synthetic construct
  source 1..20: mol_type = other DNA
gggaccaaccgctccaaaac

SEQ ID NO: 25496 - DNA, 20 bp, synthetic construct
  source 1..20: mol_type = other DNA
aggaccaggagcaccaaatc

SEQ ID NO: 25497 - DNA, 20 bp, synthetic construct
  source 1..20: mol_type = other DNA
cactgagcccctgaccctag

SEQ ID NO: 25498 - DNA, 20 bp, synthetic construct
  source 1..20: mol_type = other DNA
tggatgcaatccagacaggg

SEQ ID NO: 25499 - DNA, 20 bp, synthetic construct
  source 1..20: mol_type = other DNA
tgaccacatgtgcttttccg

SEQ ID NO: 25500 - DNA, 20 bp, synthetic construct
  source 1..20: mol_type = other DNA
agatgatgaatttgatttct

SEQ ID NO: 25501 - DNA, 20 bp, synthetic construct
  source 1..20: mol_type = other DNA
ctgaggacatcctcgaggat

SEQ ID NO: 25502 - DNA, 20 bp, synthetic construct
  source 1..20: mol_type = other DNA
ctgttcctcttcctaatcca

SEQ ID NO: 25503 - DNA, 20 bp, synthetic construct
  source 1..20: mol_type = other DNA
ctgctaattggggaacacaa

SEQ ID NO: 25504 - DNA, 20 bp, synthetic construct
  source 1..20: mol_type = other DNA
gtttagcattggtcatggtc

SEQ ID NO: 25505 - DNA, 20 bp, synthetic construct
  source 1..20: mol_type = other DNA
ccctcctgtctggttgcgca

SEQ ID NO: 25506 - DNA, 20 bp, synthetic construct
  source 1..20: mol_type = other DNA
ccttttccaagaccttcact

SEQ ID NO: 25507 - DNA, 20 bp, synthetic construct
  source 1..20: mol_type = other DNA
cctctgaatacttccactct

SEQ ID NO: 25508 - DNA, 20 bp, synthetic construct
  source 1..20: mol_type = other DNA
ttgagcgggctgtctcacag

SEQ ID NO: 25509 - DNA, 20 bp, synthetic construct
  source 1..20: mol_type = other DNA
gtcgcagcgcaagctgtggc

SEQ ID NO: 25510 - DNA, 20 bp, synthetic construct
  source 1..20: mol_type = other DNA
gccaacatcgtgacctccgt

SEQ ID NO: 25511 - DNA, 20 bp, synthetic construct
  source 1..20: mol_type = other DNA
gccgttcactctttgtccaa

SEQ ID NO: 25512 - DNA, 20 bp, synthetic construct
  source 1..20: mol_type = other DNA
ttgttgtaactccagcaaat

SEQ ID NO: 25513 - DNA, 20 bp, synthetic construct
  source 1..20: mol_type = other DNA
acaccagatacactcttgct

SEQ ID NO: 25514 - DNA, 20 bp, synthetic construct
  source 1..20: mol_type = other DNA
ttgactgctgtgggattgac

SEQ ID NO: 25515 - DNA, 20 bp, synthetic construct
  source 1..20: mol_type = other DNA
aaatctgatgaaaacccttc

SEQ ID NO: 25516 - DNA, 20 bp, synthetic construct
  source 1..20: mol_type = other DNA
gactaattccactaccccgg

SEQ ID NO: 25517 - DNA, 20 bp, synthetic construct
  source 1..20: mol_type = other DNA
ccgtaaaggatgcgtgacaa

SEQ ID NO: 25518 - DNA, 20 bp, synthetic construct
  source 1..20: mol_type = other DNA
ttacacggccgatatgtcag

SEQ ID NO: 25519 - DNA, 20 bp, synthetic construct
  source 1..20: mol_type = other DNA
aggagccatgtccactgccc

SEQ ID NO: 25520 - DNA, 20 bp, synthetic construct
  source 1..20: mol_type = other DNA
caccgccaccccgtatggaa

SEQ ID NO: 25521 - DNA, 20 bp, synthetic construct
  source 1..20: mol_type = other DNA
gaaaacaaaagtgtttttgg

SEQ ID NO: 25522 - DNA, 20 bp, synthetic construct
  source 1..20: mol_type = other DNA
taggaggtgtttgtggcctg

SEQ ID NO: 25523 - DNA, 20 bp, synthetic construct
  source 1..20: mol_type = other DNA
gacctgtcctggaacgacgg

SEQ ID NO: 25524 - DNA, 20 bp, synthetic construct
  source 1..20: mol_type = other DNA
tctggctccgttgcctttag

SEQ ID NO: 25525 - DNA, 20 bp, synthetic construct
  source 1..20: mol_type = other DNA
ggccaacgacatattccttg

SEQ ID NO: 25526 - DNA, 20 bp, synthetic construct
  source 1..20: mol_type = other DNA
catggccggcttccatcccc

SEQ ID NO: 25527 - DNA, 20 bp, synthetic construct
  source 1..20: mol_type = other DNA
gactactgaagtgcaactta

SEQ ID NO: 25528 - DNA, 20 bp, synthetic construct
  source 1..20: mol_type = other DNA
tgagatactgcgtgaagctg

SEQ ID NO: 25529 - DNA, 20 bp, synthetic construct
  source 1..20: mol_type = other DNA
aacattcacgtatcgtcagt

SEQ ID NO: 25530 - DNA, 20 bp, synthetic construct
  source 1..20: mol_type = other DNA
gacagacgctttccctgagt

SEQ ID NO: 25531 - DNA, 20 bp, synthetic construct
  source 1..20: mol_type = other DNA
ggacaacatcacagtgcctg

SEQ ID NO: 25532 - DNA, 20 bp, synthetic construct
  source 1..20: mol_type = other DNA
cacggaatttgcagagggca

SEQ ID NO: 25533 - DNA, 20 bp, synthetic construct
  source 1..20: mol_type = other DNA
ggctgaaactgctatgctta

SEQ ID NO: 25534 - DNA, 20 bp, synthetic construct
  source 1..20: mol_type = other DNA
taaagctgcccgggaagcac

SEQ ID NO: 25535 - DNA, 20 bp, synthetic construct
  source 1..20: mol_type = other DNA
tcgaagcacgctgcatatga

SEQ ID NO: 25536 - DNA, 20 bp, synthetic construct
  source 1..20: mol_type = other DNA
accaggacatgaggaaccag

SEQ ID NO: 25537 - DNA, 20 bp, synthetic construct
  source 1..20: mol_type = other DNA
agttacaagtgtttgcatga

SEQ ID NO: 25538 - DNA, 20 bp, synthetic construct
  source 1..20: mol_type = other DNA
aggcgtcattcatggagatg

SEQ ID NO: 25539 - DNA, 20 bp, synthetic construct
  source 1..20: mol_type = other DNA
agctacctgggctgataaca

SEQ ID NO: 25540 - DNA, 20 bp, synthetic construct
  source 1..20: mol_type = other DNA
acggatcatgcatcgttatg

SEQ ID NO: 25541 - DNA, 20 bp, synthetic construct
  source 1..20: mol_type = other DNA
gcagcagacgatctgttgct

SEQ ID NO: 25542 - DNA, 20 bp, synthetic construct
  source 1..20: mol_type = other DNA
gtaaaccaacagtggatttc

SEQ ID NO: 25543 - DNA, 20 bp, synthetic construct
  source 1..20: mol_type = other DNA
tggtcaagagagactggttc

SEQ ID NO: 25544 - DNA, 20 bp, synthetic construct
  source 1..20: mol_type = other DNA
cgtcagtcgagtggaactct

SEQ ID NO: 25545 - DNA, 20 bp, synthetic construct
  source 1..20: mol_type = other DNA
catatgctggaacagatgcg

SEQ ID NO: 25546 - DNA, 20 bp, synthetic construct
  source 1..20: mol_type = other DNA
ggggcaagacaatgtttgtt

SEQ ID NO: 25547 - DNA, 20 bp, synthetic construct
  source 1..20: mol_type = other DNA
cagaatactgcgacacggaa

SEQ ID NO: 25548 - DNA, 20 bp, synthetic construct
  source 1..20: mol_type = other DNA
ttctgcaaatttgtgcggct

SEQ ID NO: 25549 - DNA, 20 bp, synthetic construct
  source 1..20: mol_type = other DNA
taagagtcagcatggttaca

SEQ ID NO: 25550 - DNA, 20 bp, synthetic construct
  source 1..20: mol_type = other DNA
tgtttcacacaatgtggcac

SEQ ID NO: 25551 - DNA, 20 bp, synthetic construct
  source 1..20: mol_type = other DNA
aagatgaggaaagggaaatt

SEQ ID NO: 25552 - DNA, 20 bp, synthetic construct
  source 1..20: mol_type = other DNA
taagcccagctagtgcagca

SEQ ID NO: 25553 - DNA, 20 bp, synthetic construct
  source 1..20: mol_type = other DNA
agttctacgagccggaggct

SEQ ID NO: 25554 - DNA, 20 bp, synthetic construct
  source 1..20: mol_type = other DNA
gtgggccatctggacatctc

SEQ ID NO: 25555 - DNA, 20 bp, synthetic construct
  source 1..20: mol_type = other DNA
ctataatagaagtgctcggc

SEQ ID NO: 25556 - DNA, 20 bp, synthetic construct
  source 1..20: mol_type = other DNA
tcatgaccatgggaatacta

SEQ ID NO: 25557 - DNA, 20 bp, synthetic construct
  source 1..20: mol_type = other DNA
ttttcaacttggactggggc

SEQ ID NO: 25558 - DNA, 20 bp, synthetic construct
  source 1..20: mol_type = other DNA
acacccgagggatggaatgg

SEQ ID NO: 25559 - DNA, 20 bp, synthetic construct
  source 1..20: mol_type = other DNA
ggctggtagataaaggatat

SEQ ID NO: 25560 - DNA, 20 bp, synthetic construct
  source 1..20: mol_type = other DNA
acattgtcactctgcgtagc

SEQ ID NO: 25561 - DNA, 20 bp, synthetic construct
  source 1..20: mol_type = other DNA
tttgttgcaaggttcttgct

SEQ ID NO: 25562 - DNA, 20 bp, synthetic construct
  source 1..20: mol_type = other DNA
gcaagggaggaaagacgcta

SEQ ID NO: 25563 - DNA, 20 bp, synthetic construct
  source 1..20: mol_type = other DNA
caacaggctggaacagttgg

SEQ ID NO: 25564 - DNA, 20 bp, synthetic construct
  source 1..20: mol_type = other DNA
gtaaggcgtatgcgcaaatg

SEQ ID NO: 25565 - DNA, 20 bp, synthetic construct
  source 1..20: mol_type = other DNA
acccccccaaaaatgaaggg

SEQ ID NO: 25566 - DNA, 20 bp, synthetic construct
  source 1..20: mol_type = other DNA
ttctcttattttcactagtt

SEQ ID NO: 25567 - DNA, 20 bp, synthetic construct
  source 1..20: mol_type = other DNA
ccgtggaggatcgcccggga

SEQ ID NO: 25568 - DNA, 20 bp, synthetic construct
  source 1..20: mol_type = other DNA
cacgatattttcagttcttt

SEQ ID NO: 25569 - DNA, 20 bp, synthetic construct
  source 1..20: mol_type = other DNA
agtctccgatttttgggcgt

SEQ ID NO: 25570 - DNA, 20 bp, synthetic construct
  source 1..20: mol_type = other DNA
cttccaacgttataaaatgc

SEQ ID NO: 25571 - DNA, 20 bp, synthetic construct
  source 1..20: mol_type = other DNA
gtcgtggatggtatgtcatg

SEQ ID NO: 25572 - DNA, 20 bp, synthetic construct
  source 1..20: mol_type = other DNA
ctcatagttattcgcatgag

SEQ ID NO: 25573 - DNA, 20 bp, synthetic construct
  source 1..20: mol_type = other DNA
ccgcttttgtggatgccctt

SEQ ID NO: 25574 - DNA, 20 bp, synthetic construct
  source 1..20: mol_type = other DNA
ctttgtccttgagtgctcgt

SEQ ID NO: 25575 - DNA, 20 bp, synthetic construct
  source 1..20: mol_type = other DNA
aatatcagaatacgtgtgct

SEQ ID NO: 25576 - DNA, 20 bp, synthetic construct
  source 1..20: mol_type = other DNA
ggtatgctgggcaaccgatt

SEQ ID NO: 25577 - DNA, 20 bp, synthetic construct
  source 1..20: mol_type = other DNA
aatcagattggtcatctcgt

SEQ ID NO: 25578 - DNA, 20 bp, synthetic construct
  source 1..20: mol_type = other DNA
cagtgttcgactattgcgct

SEQ ID NO: 25579 - DNA, 20 bp, synthetic construct
  source 1..20: mol_type = other DNA
ctatgcttaaggaattggac

SEQ ID NO: 25580 - DNA, 20 bp, synthetic construct
  source 1..20: mol_type = other DNA
gccttgcatttggtggtaat

SEQ ID NO: 25581 - DNA, 20 bp, synthetic construct
  source 1..20: mol_type = other DNA
attttgactatgtttttagt

SEQ ID NO: 25582 - DNA, 20 bp, synthetic construct
  source 1..20: mol_type = other DNA
atggttctataccacgtcag

SEQ ID NO: 25583 - DNA, 20 bp, synthetic construct
  source 1..20: mol_type = other DNA
ctattgtcaatacagcttgt

SEQ ID NO: 25584 - DNA, 20 bp, synthetic construct
  source 1..20: mol_type = other DNA
ttgatggtgattatcccaag

SEQ ID NO: 25585 - DNA, 20 bp, synthetic construct
  source 1..20: mol_type = other DNA
tatcccagcgcgtggtggac

SEQ ID NO: 25586 - DNA, 20 bp, synthetic construct
  source 1..20: mol_type = other DNA
cttagtatcatggaaatgtg

SEQ ID NO: 25587 - DNA, 20 bp, synthetic construct
  source 1..20: mol_type = other DNA
atgggatctgatcagggcca

SEQ ID NO: 25588 - DNA, 20 bp, synthetic construct
  source 1..20: mol_type = other DNA
tgaccaaggattaatggctt

SEQ ID NO: 25589 - DNA, 20 bp, synthetic construct
  source 1..20: mol_type = other DNA
ctcctcccgcggtgtagata

SEQ ID NO: 25590 - DNA, 20 bp, synthetic construct
  source 1..20: mol_type = other DNA
tggttccggcgatggttaca

SEQ ID NO: 25591 - DNA, 20 bp, synthetic construct
  source 1..20: mol_type = other DNA
ccccggttttgctgccccat

SEQ ID NO: 25592 - DNA, 20 bp, synthetic construct
  source 1..20: mol_type = other DNA
cccaatcaagaccaatactc

SEQ ID NO: 25593 - DNA, 20 bp, synthetic construct
  source 1..20: mol_type = other DNA
atacaacctgcagaactcag

SEQ ID NO: 25594 - DNA, 20 bp, synthetic construct
  source 1..20: mol_type = other DNA
tgtccccgccccccgtcccg

SEQ ID NO: 25595 - DNA, 20 bp, synthetic construct
  source 1..20: mol_type = other DNA
tggtcaatctgttcacattg

SEQ ID NO: 25596 - DNA, 20 bp, synthetic construct
  source 1..20: mol_type = other DNA
taggcttactgtagatatgg

SEQ ID NO: 25597 - DNA, 20 bp, synthetic construct
  source 1..20: mol_type = other DNA
cgaggaagcgattcgtgaaa

SEQ ID NO: 25598 - DNA, 20 bp, synthetic construct
  source 1..20: mol_type = other DNA
tcgccttgtcggtgtacatg

SEQ ID NO: 25599 - DNA, 20 bp, synthetic construct
  source 1..20: mol_type = other DNA
ccattccaatcctggtatgt

SEQ ID NO: 25600 - DNA, 20 bp, synthetic construct
  source 1..20: mol_type = other DNA
gtctgccctcatctcccgtc

SEQ ID NO: 25601 - DNA, 20 bp, synthetic construct
  source 1..20: mol_type = other DNA
tttccctaactcctcttctc

SEQ ID NO: 25602 - DNA, 20 bp, synthetic construct
  source 1..20: mol_type = other DNA
tgctcaccacgctggtcccc

SEQ ID NO: 25603 - DNA, 20 bp, synthetic construct
  source 1..20: mol_type = other DNA
aggtgctctggccgagctaa

SEQ ID NO: 25604 - DNA, 20 bp, synthetic construct
  source 1..20: mol_type = other DNA
gctcattgggaagagttacc

SEQ ID NO: 25605 - DNA, 20 bp, synthetic construct
  source 1..20: mol_type = other DNA
gaaagtagttgtgtccgaga

SEQ ID NO: 25606 - DNA, 20 bp, synthetic construct
  source 1..20: mol_type = other DNA
ttgggtgattctcattctga

SEQ ID NO: 25607 - DNA, 20 bp, synthetic construct
  source 1..20: mol_type = other DNA
aagatttatgcatggcttcc

SEQ ID NO: 25608 - DNA, 20 bp, synthetic construct
  source 1..20: mol_type = other DNA
aggttggatatacaagtgcg

SEQ ID NO: 25609 - DNA, 20 bp, synthetic construct
  source 1..20: mol_type = other DNA
gaagagtatgcaggagcttt

SEQ ID NO: 25610 - DNA, 20 bp, synthetic construct
  source 1..20: mol_type = other DNA
atgcaattagtaggtgctcg

SEQ ID NO: 25611 - DNA, 20 bp, synthetic construct
  source 1..20: mol_type = other DNA
ggtgagttcatagtagataa

SEQ ID NO: 25612 - DNA, 20 bp, synthetic construct
  source 1..20: mol_type = other DNA
aatcaagggttggctttggc

SEQ ID NO: 25613 - DNA, 20 bp, synthetic construct
  source 1..20: mol_type = other DNA
aaggtgtgtgagtggtttaa

SEQ ID NO: 25614 - DNA, 20 bp, synthetic construct
  source 1..20: mol_type = other DNA
gaaaacacgcgtcaggagac

SEQ ID NO: 25615 - DNA, 20 bp, synthetic construct
  source 1..20: mol_type = other DNA
atagtgaactagtatcagat

SEQ ID NO: 25616 - DNA, 20 bp, synthetic construct
  source 1..20: mol_type = other DNA
cctatgtacttcagcgttac

SEQ ID NO: 25617 - DNA, 20 bp, synthetic construct
  source 1..20: mol_type = other DNA
cttcttatgtggcgcaagat

SEQ ID NO: 25618 - DNA, 20 bp, synthetic construct
  source 1..20: mol_type = other DNA
ttaccttacctggtatcaat

SEQ ID NO: 25619 - DNA, 20 bp, synthetic construct
  source 1..20: mol_type = other DNA
ctaatgcttatcagtttgat

SEQ ID NO: 25620 - DNA, 20 bp, synthetic construct
  source 1..20: mol_type = other DNA
atgaatattttgttcttgct

SEQ ID NO: 25621 - DNA, 20 bp, synthetic construct
  source 1..20: mol_type = other DNA
aatgtgatcacttcggtgag

SEQ ID NO: 25622 - DNA, 20 bp, synthetic construct
  source 1..20: mol_type = other DNA
agttttggatagtgaaggat

SEQ ID NO: 25623 - DNA, 20 bp, synthetic construct
  source 1..20: mol_type = other DNA
tggtgccacagtttgtttac

SEQ ID NO: 25624 - DNA, 20 bp, synthetic construct
  source 1..20: mol_type = other DNA
agactcctgaggttacagct

SEQ ID NO: 25625 - DNA, 20 bp, synthetic construct
  source 1..20: mol_type = other DNA
cacctttcccctcttcagat

SEQ ID NO: 25626 - DNA, 20 bp, synthetic construct
  source 1..20: mol_type = other DNA
ccaacatggggccaaagatt

SEQ ID NO: 25627 - DNA, 20 bp, synthetic construct
  source 1..20: mol_type = other DNA
gctttagggaaagaatgcaa

SEQ ID NO: 25628 - DNA, 20 bp, synthetic construct
  source 1..20: mol_type = other DNA
tgttctctagtgcgtgcttg

SEQ ID NO: 25629 - DNA, 20 bp, synthetic construct
  source 1..20: mol_type = other DNA
tgtggaatgatgcaacacac

SEQ ID NO: 25630 - DNA, 20 bp, synthetic construct
  source 1..20: mol_type = other DNA
gcagtgttgttgttgttgac

SEQ ID NO: 25631 - DNA, 20 bp, synthetic construct
  source 1..20: mol_type = other DNA
gaggagcccgcttttatgca

SEQ ID NO: 25632 - DNA, 20 bp, synthetic construct
  source 1..20: mol_type = other DNA
cggatgaaggcttggacatg

SEQ ID NO: 25633 - DNA, 20 bp, synthetic construct
  source 1..20: mol_type = other DNA
ctaccttttcctttcaatgc

SEQ ID NO: 25634 - DNA, 20 bp, synthetic construct
  source 1..20: mol_type = other DNA
aacatcgtggcgagcaggac

SEQ ID NO: 25635 - DNA, 20 bp, synthetic construct
  source 1..20: mol_type = other DNA
aaagaagaaaagaggaggaa

SEQ ID NO: 25636 - DNA, 20 bp, synthetic construct
  source 1..20: mol_type = other DNA
cacagtccatcatcatggcg

SEQ ID NO: 25637 - DNA, 20 bp, synthetic construct
  source 1..20: mol_type = other DNA
caaaatgatgaacatggagg

SEQ ID NO: 25638 - DNA, 20 bp, synthetic construct
  source 1..20: mol_type = other DNA
gttccatgatttaaatctgc

SEQ ID NO: 25639 - DNA, 20 bp, synthetic construct
  source 1..20: mol_type = other DNA
aagcagcaagctggaaatga

SEQ ID NO: 25640 - DNA, 20 bp, synthetic construct
  source 1..20: mol_type = other DNA
tcaaattaaatatcagtggc

SEQ ID NO: 25641 - DNA, 20 bp, synthetic construct
  source 1..20: mol_type = other DNA
acacaacatgtgggattcga

SEQ ID NO: 25642 - DNA, 20 bp, synthetic construct
  source 1..20: mol_type = other DNA
ctttacgagtccaggcatgt

SEQ ID NO: 25643 - DNA, 20 bp, synthetic construct
  source 1..20: mol_type = other DNA
atcagctcgaaccaccactg

SEQ ID NO: 25644 - DNA, 20 bp, synthetic construct
  source 1..20: mol_type = other DNA
aggcgatggcatggaaccat

SEQ ID NO: 25645 - DNA, 20 bp, synthetic construct
  source 1..20: mol_type = other DNA
gcaagattgggacatgacaa

SEQ ID NO: 25646 - DNA, 20 bp, synthetic construct
  source 1..20: mol_type = other DNA
catagggattatgtcgctga

SEQ ID NO: 25647 - DNA, 20 bp, synthetic construct
  source 1..20: mol_type = other DNA
actgacagccgttggattga

SEQ ID NO: 25648 - DNA, 20 bp, synthetic construct
  source 1..20: mol_type = other DNA
gctcacagtcaaggctccga

SEQ ID NO: 25649 - DNA, 20 bp, synthetic construct
  source 1..20: mol_type = other DNA
cgttatggatgaagcacatt

SEQ ID NO: 25650 - DNA, 20 bp, synthetic construct
  source 1..20: mol_type = other DNA
acaaaggaggggaagagtgg

SEQ ID NO: 25651 - DNA, 20 bp, synthetic construct
  source 1..20: mol_type = other DNA
agagaaggtcttttccattg

SEQ ID NO: 25652 - DNA, 20 bp, synthetic construct
  source 1..20: mol_type = other DNA
gcctcttcttttactcggat

SEQ ID NO: 25653 - DNA, 20 bp, synthetic construct
  source 1..20: mol_type = other DNA
aatagtcgccacagacatac

SEQ ID NO: 25654 - DNA, 20 bp, synthetic construct
  source 1..20: mol_type = other DNA
gccacacggaaaggttatag

SEQ ID NO: 25655 - DNA, 20 bp, synthetic construct
  source 1..20: mol_type = other DNA
gcccaaggtgcttaaagagc

SEQ ID NO: 25656 - DNA, 20 bp, synthetic construct
  source 1..20: mol_type = other DNA
ttggaactatcatggaagtt

SEQ ID NO: 25657 - DNA, 20 bp, synthetic construct
  source 1..20: mol_type = other DNA
catgtggttaggttcaagat

SEQ ID NO: 25658 - DNA, 20 bp, synthetic construct
  source 1..20: mol_type = other DNA
cgtcatctcacgggaagacc

SEQ ID NO: 25659 - DNA, 20 bp, synthetic construct
  source 1..20: mol_type = other DNA
ggcgatagtcaggccaggca

SEQ ID NO: 25660 - DNA, 20 bp, synthetic construct
  source 1..20: mol_type = other DNA
gtaggttttacgccactagc

SEQ ID NO: 25661 - DNA, 20 bp, synthetic construct
  source 1..20: mol_type = other DNA
atggtgtgccccttgtggaa

SEQ ID NO: 25662 - DNA, 20 bp, synthetic construct
  source 1..20: mol_type = other DNA
ttgagatgctacgtggacga

SEQ ID NO: 25663 - DNA, 20 bp, synthetic construct
  source 1..20: mol_type = other DNA
acttccacgtaagggagatt

SEQ ID NO: 25664 - DNA, 20 bp, synthetic construct
  source 1..20: mol_type = other DNA
gaagttttcttttgcgggta

SEQ ID NO: 25665 - DNA, 20 bp, synthetic construct
  source 1..20: mol_type = other DNA
gaaccccaaagactgtgata

SEQ ID NO: 25666 - DNA, 20 bp, synthetic construct
  source 1..20: mol_type = other DNA
tgctatagcaaaaacaactg

SEQ ID NO: 25667 - DNA, 20 bp, synthetic construct
  source 1..20: mol_type = other DNA
tctcgtttgcccaattgggt

SEQ ID NO: 25668 - DNA, 20 bp, synthetic construct
  source 1..20: mol_type = other DNA
cagacatggggtgataatag

SEQ ID NO: 25669 - DNA, 20 bp, synthetic construct
  source 1..20: mol_type = other DNA
ccccacgacaataccactta

SEQ ID NO: 25670 - DNA, 20 bp, synthetic construct
  source 1..20: mol_type = other DNA
agaagttgcagggggaacaa

SEQ ID NO: 25671 - DNA, 20 bp, synthetic construct
  source 1..20: mol_type = other DNA
tacgtcactgctgaaaatca

SEQ ID NO: 25672 - DNA, 20 bp, synthetic construct
  source 1..20: mol_type = other DNA
gaatagaggagaatttaaac

SEQ ID NO: 25673 - DNA, 20 bp, synthetic construct
  source 1..20: mol_type = other DNA
atcattcaatctgagaattg

SEQ ID NO: 25674 - DNA, 20 bp, synthetic construct
  source 1..20: mol_type = other DNA
acaagctgccactgatctag

SEQ ID NO: 25675 - DNA, 20 bp, synthetic construct
  source 1..20: mol_type = other DNA
acaaaatcctgtatcggttg

SEQ ID NO: 25676 - DNA, 20 bp, synthetic construct
  source 1..20: mol_type = other DNA
aataatggccctgtttgaag

SEQ ID NO: 25677 - DNA, 20 bp, synthetic construct
  source 1..20: mol_type = other DNA
caaaggtacattccttacta

SEQ ID NO: 25678 - DNA, 20 bp, synthetic construct
  source 1..20: mol_type = other DNA
gttcgaagagctcatgcttc

SEQ ID NO: 25679 - DNA, 20 bp, synthetic construct
  source 1..20: mol_type = other DNA
cgtgtacaacaagattatag

SEQ ID NO: 25680 - DNA, 20 bp, synthetic construct
  source 1..20: mol_type = other DNA
attcaacaccctgaagaaaa

SEQ ID NO: 25681 - DNA, 20 bp, synthetic construct
  source 1..20: mol_type = other DNA
acagaagccggtggtaatac

SEQ ID NO: 25682 - DNA, 20 bp, synthetic construct
  source 1..20: mol_type = other DNA
ggcatatgaaaaagccgttg

SEQ ID NO: 25683 - DNA, 20 bp, synthetic construct
  source 1..20: mol_type = other DNA
cagtcggcagggtcgacccc

SEQ ID NO: 25684 - DNA, 20 bp, synthetic construct
  source 1..20: mol_type = other DNA
ccgcccttttaacgcttcgg

SEQ ID NO: 25685 - DNA, 20 bp, synthetic construct
  source 1..20: mol_type = other DNA
gctgcataaatcccccccct

SEQ ID NO: 25686 - DNA, 20 bp, synthetic construct
  source 1..20: mol_type = other DNA
gggagctgtatggcgcgggg

SEQ ID NO: 25687 - DNA, 20 bp, synthetic construct
  source 1..20: mol_type = other DNA
agcttcctggcgctctctgg

SEQ ID NO: 25688 - DNA, 20 bp, synthetic construct
  source 1..20: mol_type = other DNA
gccctaaaatttctgaccat

SEQ ID NO: 25689 - DNA, 20 bp, synthetic construct
  source 1..20: mol_type = other DNA
tggcttggttccctgtggaa

SEQ ID NO: 25690 - DNA, 20 bp, synthetic construct
  source 1..20: mol_type = other DNA
gctttgactatgtcggccca

SEQ ID NO: 25691 - DNA, 20 bp, synthetic construct
  source 1..20: mol_type = other DNA
ggtctgccttgggcttggag

SEQ ID NO: 25692 - DNA, 20 bp, synthetic construct
  source 1..20: mol_type = other DNA
tccttgaagcttgcctctgt

SEQ ID NO: 25693 - DNA, 20 bp, synthetic construct
  source 1..20: mol_type = other DNA
tcctgaaggaattggagtgc

SEQ ID NO: 25694 - DNA, 20 bp, synthetic construct
  source 1..20: mol_type = other DNA
tgttcacaacgtggcactcc

SEQ ID NO: 25695 - DNA, 20 bp, synthetic construct
  source 1..20: mol_type = other DNA
atgggggcctagcccatgga

SEQ ID NO: 25696 - DNA, 20 bp, synthetic construct
  source 1..20: mol_type = other DNA
gctatgttgagccctggaag

SEQ ID NO: 25697 - DNA, 20 bp, synthetic construct
  source 1..20: mol_type = other DNA
tccttgttctaaatcctagc

SEQ ID NO: 25698 - DNA, 20 bp, synthetic construct
  source 1..20: mol_type = other DNA
gcctcctgcgggcctacgca

SEQ ID NO: 25699 - DNA, 20 bp, synthetic construct
  source 1..20: mol_type = other DNA
ctgctggaccgattctgttg

SEQ ID NO: 25700 - DNA, 20 bp, synthetic construct
  source 1..20: mol_type = other DNA
ggacggcgcttacaggaaat

SEQ ID NO: 25701 - DNA, 20 bp, synthetic construct
  source 1..20: mol_type = other DNA
gtactggtacccccgaagca

SEQ ID NO: 25702 - DNA, 20 bp, synthetic construct
  source 1..20: mol_type = other DNA
aggacgtcactgctcgtgca

SEQ ID NO: 25703 - DNA, 20 bp, synthetic construct
  source 1..20: mol_type = other DNA
ttgcttatgtgaaggacagg

SEQ ID NO: 25704 - DNA, 20 bp, synthetic construct
  source 1..20: mol_type = other DNA
tgcccgagattatcccccct

SEQ ID NO: 25705 - DNA, 20 bp, synthetic construct
  source 1..20: mol_type = other DNA
ccggcgtcacccccacgcag

SEQ ID NO: 25706 - DNA, 20 bp, synthetic construct
  source 1..20: mol_type = other DNA
tcttcgcgtgcaaccatgct

SEQ ID NO: 25707 - DNA, 20 bp, synthetic construct
  source 1..20: mol_type = other DNA
ctgcctgtcgcaagataggc

SEQ ID NO: 25708 - DNA, 20 bp, synthetic construct
  source 1..20: mol_type = other DNA
tgttgattccgacactgctt

SEQ ID NO: 25709 - DNA, 20 bp, synthetic construct
  source 1..20: mol_type = other DNA
cactgtcagaagcacaaaaa

SEQ ID NO: 25710 - DNA, 20 bp, synthetic construct
  source 1..20: mol_type = other DNA
acttaattgtggggatgtcg

SEQ ID NO: 25711 - DNA, 20 bp, synthetic construct
  source 1..20: mol_type = other DNA
ccgccaatctaactctacgt

SEQ ID NO: 25712 - DNA, 20 bp, synthetic construct
  source 1..20: mol_type = other DNA
ggagcgtgtggcccgcagcc

SEQ ID NO: 25713 - DNA, 20 bp, synthetic construct
  source 1..20: mol_type = other DNA
ccgaggggacgtgttccaga

SEQ ID NO: 25714 - DNA, 20 bp, synthetic construct
  source 1..20: mol_type = other DNA
gatgtacgccatgaagtgcc

SEQ ID NO: 25715 - DNA, 20 bp, synthetic construct
  source 1..20: mol_type = other DNA
catgaacggtggggacctgc

SEQ ID NO: 25716 - DNA, 20 bp, synthetic construct
  source 1..20: mol_type = other DNA
ccccttccggcagcacaaga

SEQ ID NO: 25717 - DNA, 20 bp, synthetic construct
  source 1..20: mol_type = other DNA
gaaagagagcccctttttcc

SEQ ID NO: 25718 - DNA, 20 bp, synthetic construct
  source 1..20: mol_type = other DNA
cctcaagatccgcggtggga

SEQ ID NO: 25719 - DNA, 20 bp, synthetic construct
  source 1..20: mol_type = other DNA
ctgcactctgtgcccatggg

SEQ ID NO: 25720 - DNA, 20 bp, synthetic construct
  source 1..20: mol_type = other DNA
ccagcacccgggctcaggga

SEQ ID NO: 25721 - DNA, 20 bp, synthetic construct
  source 1..20: mol_type = other DNA
cagctatgcgggttgacaat

SEQ ID NO: 25722 - DNA, 20 bp, synthetic construct
  source 1..20: mol_type = other DNA
atgtctggtggcttatggct

SEQ ID NO: 25723 - DNA, 20 bp, synthetic construct
  source 1..20: mol_type = other DNA
accttacagtttggccttct

SEQ ID NO: 25724 - DNA, 20 bp, synthetic construct
  source 1..20: mol_type = other DNA
atgtggttcctgcgtccgcg

SEQ ID NO: 25725 - DNA, 20 bp, synthetic construct
  source 1..20: mol_type = other DNA
ttcgccggcttggttgctta

SEQ ID NO: 25726 - DNA, 20 bp, synthetic construct
  source 1..20: mol_type = other DNA
gtcagactttcgcgggtctt

SEQ ID NO: 25727 - DNA, 20 bp, synthetic construct
  source 1..20: mol_type = other DNA
tcgggcgaggttactcgctc

SEQ ID NO: 25728 - DNA, 20 bp, synthetic construct
  source 1..20: mol_type = other DNA
tgacaccgtaacagactgtg

SEQ ID NO: 25729 - DNA, 20 bp, synthetic construct
  source 1..20: mol_type = other DNA
gaggacagtgcctgttggcg

SEQ ID NO: 25730 - DNA, 20 bp, synthetic construct
  source 1..20: mol_type = other DNA
cgttcggagggcggtgcgag

SEQ ID NO: 25731 - DNA, 20 bp, synthetic construct
  source 1..20: mol_type = other DNA
atctggcagtgttgccggta

SEQ ID NO: 25732 - DNA, 20 bp, synthetic construct
  source 1..20: mol_type = other DNA
agaggtatctactcctatat

SEQ ID NO: 25733 - DNA, 20 bp, synthetic construct
  source 1..20: mol_type = other DNA
taccaaagtttatgttactg

SEQ ID NO: 25734 - DNA, 20 bp, synthetic construct
  source 1..20: mol_type = other DNA
agttaggcgccgagcagccg

SEQ ID NO: 25735 - DNA, 20 bp, synthetic construct
  source 1..20: mol_type = other DNA
aagattcatagttttcccac

SEQ ID NO: 25736 - DNA, 20 bp, synthetic construct
  source 1..20: mol_type = other DNA
gtgtaggtcgtcgggcgtgt

SEQ ID NO: 25737 - DNA, 20 bp, synthetic construct
  source 1..20: mol_type = other DNA
cctactgaagtagacgtaat

SEQ ID NO: 25738 - DNA, 20 bp, synthetic construct
  source 1..20: mol_type = other DNA
tccacaggtgttggtcctac

SEQ ID NO: 25739 - DNA, 20 bp, synthetic construct
  source 1..20: mol_type = other DNA
gctggagcagcgtattgtca

SEQ ID NO: 25740 - DNA, 20 bp, synthetic construct
  source 1..20: mol_type = other DNA
tgggaacgtcacacttttgt

SEQ ID NO: 25741 - DNA, 20 bp, synthetic construct
  source 1..20: mol_type = other DNA
gggttctgtgtcttggtttg

SEQ ID NO: 25742 - DNA, 20 bp, synthetic construct
  source 1..20: mol_type = other DNA
caggcggcctgcctcgtgtg

SEQ ID NO: 25743 - DNA, 20 bp, synthetic construct
  source 1..20: mol_type = other DNA
ggatgcgggcaacttcattc

SEQ ID NO: 25744 - DNA, 20 bp, synthetic construct
  source 1..20: mol_type = other DNA
gatggggatttccgccactc

SEQ ID NO: 25745 - DNA, 20 bp, synthetic construct
  source 1..20: mol_type = other DNA
tttcgacgcgctcgattggg

SEQ ID NO: 25746 - DNA, 20 bp, synthetic construct
  source 1..20: mol_type = other DNA
gcacaaggtcctgattctca

SEQ ID NO: 25747 - DNA, 20 bp, synthetic construct
  source 1..20: mol_type = other DNA
atccataattgagacaaagc

SEQ ID NO: 25748 - DNA, 20 bp, synthetic construct
  source 1..20: mol_type = other DNA
gggtaaggacagttccatca

SEQ ID NO: 25749 - DNA, 20 bp, synthetic construct
  source 1..20: mol_type = other DNA
tgcttcggctgaattgtcga

SEQ ID NO: 25750 - DNA, 20 bp, synthetic construct
  source 1..20: mol_type = other DNA
cccggtagaccatcggccgg

SEQ ID NO: 25751 - DNA, 20 bp, synthetic construct
  source 1..20: mol_type = other DNA
gtggctcgctggctgctaca

SEQ ID NO: 25752 - DNA, 20 bp, synthetic construct
  source 1..20: mol_type = other DNA
ggggtacgtctgggatctgt

SEQ ID NO: 25753 - DNA, 20 bp, synthetic construct
  source 1..20: mol_type = other DNA
tgaggtggtggtgaccccta

SEQ ID NO: 25754 - DNA, 20 bp, synthetic construct
  source 1..20: mol_type = other DNA
tgttaccattgatggggagc

SEQ ID NO: 25755 - DNA, 20 bp, synthetic construct
  source 1..20: mol_type = other DNA
gacctcctcgcaggaggaca

SEQ ID NO: 25756 - DNA, 20 bp, synthetic construct
  source 1..20: mol_type = other DNA
ggcacgccaagagacccttg

SEQ ID NO: 25757 - DNA, 20 bp, synthetic construct
  source 1..20: mol_type = other DNA
gctcattctgggagacccgg

SEQ ID NO: 25758 - DNA, 20 bp, synthetic construct
  source 1..20: mol_type = other DNA
agggagtggtactctgttat

SEQ ID NO: 25759 - DNA, 20 bp, synthetic construct
  source 1..20: mol_type = other DNA
caaacaatggacaaggtgtg

SEQ ID NO: 25760 - DNA, 20 bp, synthetic construct
  source 1..20: mol_type = other DNA
ggtatttttggtgaaaacat

SEQ ID NO: 25761 - DNA, 20 bp, synthetic construct
  source 1..20: mol_type = other DNA
ttttgtggtactgccaacac

SEQ ID NO: 25762 - DNA, 20 bp, synthetic construct
  source 1..20: mol_type = other DNA
aacacatcaccaggtagatc

SEQ ID NO: 25763 - DNA, 20 bp, synthetic construct
  source 1..20: mol_type = other DNA
atagcacagaaccctgttga

SEQ ID NO: 25764 - DNA, 20 bp, synthetic construct
  source 1..20: mol_type = other DNA
ttcacctatactaggtttga

SEQ ID NO: 25765 - DNA, 20 bp, synthetic construct
  source 1..20: mol_type = other DNA
atgtatgttcatgtaggtaa

SEQ ID NO: 25766 - DNA, 20 bp, synthetic construct
  source 1..20: mol_type = other DNA
aaaattattaaatggatgtt

SEQ ID NO: 25767 - DNA, 20 bp, synthetic construct
  source 1..20: mol_type = other DNA
aatccagccggggatgacat

SEQ ID NO: 25768 - DNA, 20 bp, synthetic construct
  source 1..20: mol_type = other DNA
tcttgcaacaaatacagcct

SEQ ID NO: 25769 - DNA, 20 bp, synthetic construct
  source 1..20: mol_type = other DNA
attaagtattgtgagggtaa

SEQ ID NO: 25770 - DNA, 20 bp, synthetic construct
  source 1..20: mol_type = other DNA
cctggttcaaaagaaccagc

SEQ ID NO: 25771 - DNA, 20 bp, synthetic construct
  source 1..20: mol_type = other DNA
aaacctattacacttgagga

SEQ ID NO: 25772 - DNA, 20 bp, synthetic construct
  source 1..20: mol_type = other DNA
gcagttggatgtgatccaga

SEQ ID NO: 25773 - DNA, 20 bp, synthetic construct
  source 1..20: mol_type = other DNA
ctatgcaagtctaaacacat

SEQ ID NO: 25774 - DNA, 20 bp, synthetic construct
  source 1..20: mol_type = other DNA
tatggtgatgatgtcatatt

SEQ ID NO: 25775 - DNA, 20 bp, synthetic construct
  source 1..20: mol_type = other DNA
aagaacaggtactatgagcc

SEQ ID NO: 25776 - DNA, 20 bp, synthetic construct
  source 1..20: mol_type = other DNA
ggccacaacctttttgatct

SEQ ID NO: 25777 - DNA, 20 bp, synthetic construct
  source 1..20: mol_type = other DNA
cctctgctgcttctccttgg

SEQ ID NO: 25778 - DNA, 20 bp, synthetic construct
  source 1..20: mol_type = other DNA
tttttttgtttttccccttt

SEQ ID NO: 25779 - DNA, 20 bp, synthetic construct
  source 1..20: mol_type = other DNA
cttttacaacagggggagaa

SEQ ID NO: 25780 - DNA, 20 bp, synthetic construct
  source 1..20: mol_type = other DNA
ccgagccgcccgatctgttt

SEQ ID NO: 25781 - DNA, 20 bp, synthetic construct
  source 1..20: mol_type = other DNA
cttccgaagagtgcgtgttt

SEQ ID NO: 25782 - DNA, 20 bp, synthetic construct
  source 1..20: mol_type = other DNA
ccttcttatgattgttgttt

SEQ ID NO: 25783 - DNA, 20 bp, synthetic construct
  source 1..20: mol_type = other DNA
caaggctacttaaaaaaatc

SEQ ID NO: 25784 - DNA, 20 bp, synthetic construct
  source 1..20: mol_type = other DNA
agtctcagctcttgcttttc

SEQ ID NO: 25785 - DNA, 20 bp, synthetic construct
  source 1..20: mol_type = other DNA
tggccttgttacgggagata

SEQ ID NO: 25786 - DNA, 20 bp, synthetic construct
  source 1..20: mol_type = other DNA
tgtttgctgatcgttttact

SEQ ID NO: 25787 - DNA, 20 bp, synthetic construct
  source 1..20: mol_type = other DNA
ctgcaagcaagattcgtgga

SEQ ID NO: 25788 - DNA, 20 bp, synthetic construct
  source 1..20: mol_type = other DNA
gtggaaaactcctgttgccg

SEQ ID NO: 25789 - DNA, 20 bp, synthetic construct
  source 1..20: mol_type = other DNA
ccaggcgcgtcctgccttca

SEQ ID NO: 25790 - DNA, 20 bp, synthetic construct
  source 1..20: mol_type = other DNA
tgctgttcggagtttaatca

SEQ ID NO: 25791 - DNA, 20 bp, synthetic construct
  source 1..20: mol_type = other DNA
cgactcctgattcattggga

SEQ ID NO: 25792 - DNA, 20 bp, synthetic construct
  source 1..20: mol_type = other DNA
taacctttcagcatcacaga

SEQ ID NO: 25793 - DNA, 20 bp, synthetic construct
  source 1..20: mol_type = other DNA
atttcctgcgtctcatgcca

SEQ ID NO: 25794 - DNA, 20 bp, synthetic construct
  source 1..20: mol_type = other DNA
taaaaatcttagttcatgtg

SEQ ID NO: 25795 - DNA, 20 bp, synthetic construct
  source 1..20: mol_type = other DNA
cccatagcagcgggcgggca

SEQ ID NO: 25796 - DNA, 20 bp, synthetic construct
  source 1..20: mol_type = other DNA
aggacgcgactctcccgacg

SEQ ID NO: 25797 - DNA, 20 bp, synthetic construct
  source 1..20: mol_type = other DNA
gcggggaggctattctgccc

SEQ ID NO: 25798 - DNA, 20 bp, synthetic construct
  source 1..20: mol_type = other DNA
ctttcccctcccttccctat

SEQ ID NO: 25799 - DNA, 20 bp, synthetic construct
  source 1..20: mol_type = other DNA
acttggggactgctggtggg

SEQ ID NO: 25800 - DNA, 20 bp, synthetic construct
  source 1..20: mol_type = other DNA
gtgtatatatgtatgtgtgt

SEQ ID NO: 25801 - DNA, 20 bp, synthetic construct
  source 1..20: mol_type = other DNA
gaggccaacctactaacagg

SEQ ID NO: 25802 - DNA, 20 bp, synthetic construct
  source 1..20: mol_type = other DNA
ttcttctcatggggtttctc

SEQ ID NO: 25803 - DNA, 20 bp, synthetic construct
  source 1..20: mol_type = other DNA
gagagagaggacaagtggat

SEQ ID NO: 25804 - DNA, 20 bp, synthetic construct
  source 1..20: mol_type = other DNA
catcgcctccttttctggga

SEQ ID NO: 25805 - DNA, 20 bp, synthetic construct
  source 1..20: mol_type = other DNA
gctggccaccttcggaacca

SEQ ID NO: 25806 - DNA, 20 bp, synthetic construct
  source 1..20: mol_type = other DNA
gttcactgtgcagggattgt

SEQ ID NO: 25807 - DNA, 20 bp, synthetic construct
  source 1..20: mol_type = other DNA
tcgcgggaaactgaagtggt

SEQ ID NO: 25808 - DNA, 20 bp, synthetic construct
  source 1..20: mol_type = other DNA
tagtttcattgtggtataaa

SEQ ID NO: 25809 - DNA, 20 bp, synthetic construct
  source 1..20: mol_type = other DNA
cggtcctcgcagagttgcgg

SEQ ID NO: 25810 - DNA, 20 bp, synthetic construct
  source 1..20: mol_type = other DNA
ctaattcccttctttgggct

SEQ ID NO: 25811 - DNA, 20 bp, synthetic construct
  source 1..20: mol_type = other DNA
agctggccggcggaggcgtg

SEQ ID NO: 25812 - DNA, 20 bp, synthetic construct
  source 1..20: mol_type = other DNA
aaactcgacccgggaacaaa

SEQ ID NO: 25813 - DNA, 20 bp, synthetic construct
  source 1..20: mol_type = other DNA
ctccgcagtgccctccactg

SEQ ID NO: 25814 - DNA, 20 bp, synthetic construct
  source 1..20: mol_type = other DNA
gaagcgaaagggaagaaaat

SEQ ID NO: 25815 - DNA, 20 bp, synthetic construct
  source 1..20: mol_type = other DNA
gggtggctcctttttctttt

SEQ ID NO: 25816 - DNA, 20 bp, synthetic construct
  source 1..20: mol_type = other DNA
gtttcgttatcttctgatcc

SEQ ID NO: 25817 - DNA, 20 bp, synthetic construct
  source 1..20: mol_type = other DNA
atccggggtaactacagtgg

SEQ ID NO: 25818 - DNA, 20 bp, synthetic construct
  source 1..20: mol_type = other DNA
cgcgcgcaaatcccggcgac

SEQ ID NO: 25819 - DNA, 20 bp, synthetic construct
  source 1..20: mol_type = other DNA
agacattgatttttctcccc

SEQ ID NO: 25820 - DNA, 20 bp, synthetic construct
  source 1..20: mol_type = other DNA
cccagccctgtcgccccccg

SEQ ID NO: 25821 - DNA, 20 bp, synthetic construct
  source 1..20: mol_type = other DNA
aggcgcacgcgcccagcacc

SEQ ID NO: 25822 - DNA, 20 bp, synthetic construct
  source 1..20: mol_type = other DNA
tgatatatttcaatccattg

SEQ ID NO: 25823 - DNA, 20 bp, synthetic construct
  source 1..20: mol_type = other DNA
gctcactttgccagtaagag

SEQ ID NO: 25824 - DNA, 20 bp, synthetic construct
  source 1..20: mol_type = other DNA
atttctctaaggaccctgat

SEQ ID NO: 25825 - DNA, 20 bp, synthetic construct
  source 1..20: mol_type = other DNA
tattttagggccgattcttt

SEQ ID NO: 25826 - DNA, 20 bp, synthetic construct
  source 1..20: mol_type = other DNA
gattggcagccagactgcct

SEQ ID NO: 25827 - DNA, 20 bp, synthetic construct
  source 1..20: mol_type = other DNA
tgagtcaggaaacattttca

SEQ ID NO: 25828 - DNA, 20 bp, synthetic construct
  source 1..20: mol_type = other DNA
aaagccaactttggaaaaag

SEQ ID NO: 25829 - DNA, 20 bp, synthetic construct
  source 1..20: mol_type = other DNA
aaaagctaagccggcgggca

SEQ ID NO: 25830 - DNA, 20 bp, synthetic construct
  source 1..20: mol_type = other DNA
acgaaccatcgactgccgtg

SEQ ID NO: 25831 - DNA, 20 bp, synthetic construct
  source 1..20: mol_type = other DNA
tgggcgcccccacaccggta

SEQ ID NO: 25832 - DNA, 20 bp, synthetic construct
  source 1..20: mol_type = other DNA
ccggccgtggatgctcactc

SEQ ID NO: 25833 - DNA, 20 bp, synthetic construct
  source 1..20: mol_type = other DNA
ggagtcggtggcagcggcgg

SEQ ID NO: 25834 - DNA, 20 bp, synthetic construct
  source 1..20: mol_type = other DNA
cgagccgctcaccccgccgt

SEQ ID NO: 25835 - DNA, 20 bp, synthetic construct
  source 1..20: mol_type = other DNA
tcggccttccgcgccagccg

SEQ ID NO: 25836 - DNA, 20 bp, synthetic construct
  source 1..20: mol_type = other DNA
aagccagccactggagtcgc

SEQ ID NO: 25837 - DNA, 20 bp, synthetic construct
  source 1..20: mol_type = other DNA
ggacctgctgtccgacttac

SEQ ID NO: 25838 - DNA, 20 bp, synthetic construct
  source 1..20: mol_type = other DNA
aggaggaagaggaggaggag

SEQ ID NO: 25839 - DNA, 20 bp, synthetic construct
  source 1..20: mol_type = other DNA
gttttattctgcctgcttaa

SEQ ID NO: 25840 - DNA, 20 bp, synthetic construct
  source 1..20: mol_type = other DNA
agtatttagaattagaatgt

SEQ ID NO: 25841 - DNA, 20 bp, synthetic construct
  source 1..20: mol_type = other DNA
tcatcaaacttctccgtcag

SEQ ID NO: 25842 - DNA, 20 bp, synthetic construct
  source 1..20: mol_type = other DNA
gagtgccaccggggaagctt

SEQ ID NO: 25843 - DNA, 20 bp, synthetic construct
  source 1..20: mol_type = other DNA
ggaaaccgtgtgataagaac

SEQ ID NO: 25844 - DNA, 20 bp, synthetic construct
  source 1..20: mol_type = other DNA
gatgctgaatctctttgtcg

SEQ ID NO: 25845 - DNA, 20 bp, synthetic construct
  source 1..20: mol_type = other DNA
gtctgggccgagtatgaccc

SEQ ID NO: 25846 - DNA, 20 bp, synthetic construct
  source 1..20: mol_type = other DNA
catgtatcagatgctgagac

SEQ ID NO: 25847 - DNA, 20 bp, synthetic construct
  source 1..20: mol_type = other DNA
ccgcacagccctggacatca

SEQ ID NO: 25848 - DNA, 20 bp, synthetic construct
  source 1..20: mol_type = other DNA
cgtctcactccgctcgcgga

SEQ ID NO: 25849 - DNA, 20 bp, synthetic construct
  source 1..20: mol_type = other DNA
agcgaggggtgtgtgccatc

SEQ ID NO: 25850 - DNA, 20 bp, synthetic construct
  source 1..20: mol_type = other DNA
gggtgaagcggcgactggag

SEQ ID NO: 25851 - DNA, 20 bp, synthetic construct
  source 1..20: mol_type = other DNA
gacgccgcttggagatcccg

SEQ ID NO: 25852 - DNA, 20 bp, synthetic construct
  source 1..20: mol_type = other DNA
cagctagcaggtgtgagcgg

SEQ ID NO: 25853 - DNA, 20 bp, synthetic construct
  source 1..20: mol_type = other DNA
acgaggactctgcaataccc

SEQ ID NO: 25854 - DNA, 20 bp, synthetic construct
  source 1..20: mol_type = other DNA
gttccgtggatatttgggat

SEQ ID NO: 25855 - DNA, 20 bp, synthetic construct
  source 1..20: mol_type = other DNA
tttatttttcgcacttgctg

SEQ ID NO: 25856 - DNA, 20 bp, synthetic construct
  source 1..20: mol_type = other DNA
tgagtttgcctctgctggaa

SEQ ID NO: 25857 - DNA, 20 bp, synthetic construct
  source 1..20: mol_type = other DNA
gcaatggctgggcatatttt

SEQ ID NO: 25858 - DNA, 20 bp, synthetic construct
  source 1..20: mol_type = other DNA
ttttctaggcacaacttctg

SEQ ID NO: 25859 - DNA, 20 bp, synthetic construct
  source 1..20: mol_type = other DNA
gtggcgtcatcaccggacag

SEQ ID NO: 25860 - DNA, 20 bp, synthetic construct
  source 1..20: mol_type = other DNA
tgtttgaggaacactaggct

SEQ ID NO: 25861 - DNA, 20 bp, synthetic construct
  source 1..20: mol_type = other DNA
aacgccgagtctctgagaag

SEQ ID NO: 25862 - DNA, 20 bp, synthetic construct
  source 1..20: mol_type = other DNA
aatatcccacgtcttctaag

SEQ ID NO: 25863 - DNA, 20 bp, synthetic construct
  source 1..20: mol_type = other DNA
tgtgggcccaacgtgaggag

SEQ ID NO: 25864 - DNA, 20 bp, synthetic construct
  source 1..20: mol_type = other DNA
gtgcccctggctgggcaaaa

SEQ ID NO: 25865 - DNA, 20 bp, synthetic construct
  source 1..20: mol_type = other DNA
cactgccctcgaacgcctca

SEQ ID NO: 25866 - DNA, 20 bp, synthetic construct
  source 1..20: mol_type = other DNA
gagcgcgaggccggagggct

SEQ ID NO: 25867 - DNA, 20 bp, synthetic construct
  source 1..20: mol_type = other DNA
tccaccgggtatgaagctaa

SEQ ID NO: 25868 - DNA, 20 bp, synthetic construct
  source 1..20: mol_type = other DNA
cctccaccagggctgaggga

SEQ ID NO: 25869 - DNA, 20 bp, synthetic construct
  source 1..20: mol_type = other DNA
gaggccatggtgacctgaga

SEQ ID NO: 25870 - DNA, 20 bp, synthetic construct
  source 1..20: mol_type = other DNA
ctccttctgcctcccctctc

SEQ ID NO: 25871 - DNA, 20 bp, synthetic construct
  source 1..20: mol_type = other DNA
tggcagaagcagacaggagc

SEQ ID NO: 25872 - DNA, 20 bp, synthetic construct
  source 1..20: mol_type = other DNA
tccagctggctgcttgtttt

SEQ ID NO: 25873 - DNA, 20 bp, synthetic construct
  source 1..20: mol_type = other DNA
gctgacggggcggcggcggg

SEQ ID NO: 25874 - DNA, 20 bp, synthetic construct
  source 1..20: mol_type = other DNA
ggcggcttctccatgggtcc

SEQ ID NO: 25875 - DNA, 20 bp, synthetic construct
  source 1..20: mol_type = other DNA
gccgggcgcgggatttctcc

SEQ ID NO: 25876 - DNA, 20 bp, synthetic construct
  source 1..20: mol_type = other DNA
attcctgcagagggaaaact

SEQ ID NO: 25877 - DNA, 20 bp, synthetic construct
  source 1..20: mol_type = other DNA
cccctttggatcttgtcggg

SEQ ID NO: 25878 - DNA, 20 bp, synthetic construct
  source 1..20: mol_type = other DNA
taaaataaattcctaaagtc

SEQ ID NO: 25879 - DNA, 20 bp, synthetic construct
  source 1..20: mol_type = other DNA
tcaggacgagggccacacca

SEQ ID NO: 25880 - DNA, 20 bp, synthetic construct
  source 1..20: mol_type = other DNA
aatgacatggaaaattcgcc

SEQ ID NO: 25881 - DNA, 20 bp, synthetic construct
  source 1..20: mol_type = other DNA
caaagcacaaaattaatttc

SEQ ID NO: 25882 - DNA, 20 bp, synthetic construct
  source 1..20: mol_type = other DNA
ggacggtctgcggcaaattg

SEQ ID NO: 25883 - DNA, 20 bp, synthetic construct
  source 1..20: mol_type = other DNA
ggagatacggatacctctgg

SEQ ID NO: 25884 - DNA, 20 bp, synthetic construct
  source 1..20: mol_type = other DNA
cgtttgcaaaatctcaaaag

SEQ ID NO: 25885 - DNA, 20 bp, synthetic construct
  source 1..20: mol_type = other DNA
ggagacgagattttctacca

SEQ ID NO: 25886 - DNA, 20 bp, synthetic construct
  source 1..20: mol_type = other DNA
gaaaagtagctaaaagcacg

SEQ ID NO: 25887 - DNA, 20 bp, synthetic construct
  source 1..20: mol_type = other DNA
tagctaaaagcacgcggaca

SEQ ID NO: 25888 - DNA, 20 bp, synthetic construct
  source 1..20: mol_type = other DNA
agtccgcgctgcgagcataa

SEQ ID NO: 25889 - DNA, 20 bp, synthetic construct
  source 1..20: mol_type = other DNA
tgaacatatttcaagggact

SEQ ID NO: 25890 - DNA, 20 bp, synthetic construct
  source 1..20: mol_type = other DNA
aacgacaacaacagcaacga

SEQ ID NO: 25891 - DNA, 20 bp, synthetic construct
  source 1..20: mol_type = other DNA
agtagcagcaccagctaccc

SEQ ID NO: 25892 - DNA, 20 bp, synthetic construct
  source 1..20: mol_type = other DNA
actttacacttaataatata

SEQ ID NO: 25893 - DNA, 20 bp, synthetic construct
  source 1..20: mol_type = other DNA
tgtcacacagtaaacggcgc

SEQ ID NO: 25894 - DNA, 20 bp, synthetic construct
  source 1..20: mol_type = other DNA
ctttgttttattatccacat

SEQ ID NO: 25895 - DNA, 20 bp, synthetic construct
  source 1..20: mol_type = other DNA
tcagcgctttaccgctcgcc

SEQ ID NO: 25896 - DNA, 20 bp, synthetic construct
  source 1..20: mol_type = other DNA
aacactcaaataaaatccgc

SEQ ID NO: 25897 - DNA, 20 bp, synthetic construct
  source 1..20: mol_type = other DNA
cccctcccccaactgtaact

SEQ ID NO: 25898 - DNA, 20 bp, synthetic construct
  source 1..20: mol_type = other DNA
agtatcaatagactgctcac

SEQ ID NO: 25899 - DNA, 20 bp, synthetic construct
  source 1..20: mol_type = other DNA
cacgggcgaccgtggcggtg

SEQ ID NO: 25900 - DNA, 20 bp, synthetic construct
  source 1..20: mol_type = other DNA
tggtagtcctccggcccctg

SEQ ID NO: 25901 - DNA, 20 bp, synthetic construct
  source 1..20: mol_type = other DNA
catattgccgtcttttggca

SEQ ID NO: 25902 - DNA, 20 bp, synthetic construct
  source 1..20: mol_type = other DNA
tcttgacgagcattcctagg

SEQ ID NO: 25903 - DNA, 20 bp, synthetic construct
  source 1..20: mol_type = other DNA
gcgacaggtgcctctgcggc

SEQ ID NO: 25904 - DNA, 20 bp, synthetic construct
  source 1..20: mol_type = other DNA
gagtatcaataggctgctcg

SEQ ID NO: 25905 - DNA, 20 bp, synthetic construct
  source 1..20: mol_type = other DNA
tcgctcagcacaaccccagt

SEQ ID NO: 25906 - DNA, 20 bp, synthetic construct
  source 1..20: mol_type = other DNA
tgctcacaaaccagtgggtg

SEQ ID NO: 25907 - DNA, 20 bp, synthetic construct
  source 1..20: mol_type = other DNA
ggctccacgctcgatccact

SEQ ID NO: 25908 - DNA, 20 bp, synthetic construct
  source 1..20: mol_type = other DNA
gaccggccgggtggaaggcc

SEQ ID NO: 25909 - DNA, 20 bp, synthetic construct
  source 1..20: mol_type = other DNA
gaaggggtacgtctatgggt

SEQ ID NO: 25910 - DNA, 20 bp, synthetic construct
  source 1..20: mol_type = other DNA
agtgttagggttcgtaggtg

SEQ ID NO: 25911 - DNA, 20 bp, synthetic construct
  source 1..20: mol_type = other DNA
tttggacacggtccacaggt

SEQ ID NO: 25912 - DNA, 20 bp, synthetic construct
  source 1..20: mol_type = other DNA
tgaagcgtcagtcgttaaac

SEQ ID NO: 25913 - DNA, 20 bp, synthetic construct
  source 1..20: mol_type = other DNA
ctcttgagactggccgaaag

SEQ ID NO: 25914 - DNA, 20 bp, synthetic construct
  source 1..20: mol_type = other DNA
gctgcatgcggcaaggggaa

SEQ ID NO: 25915 - DNA, 20 bp, synthetic construct
  source 1..20: mol_type = other DNA
gacgtaatggccccggcccg

SEQ ID NO: 25916 - DNA, 20 bp, synthetic construct
  source 1..20: mol_type = other DNA
aaaagcgcacggtccacagg

SEQ ID NO: 25917 - DNA, 20 bp, synthetic construct
  source 1..20: mol_type = other DNA
gtagccggcgagttgacaag

SEQ ID NO: 25918 - DNA, 20 bp, synthetic construct
  source 1..20: mol_type = other DNA
cagctccgcggcggcctaca

SEQ ID NO: 25919 - DNA, 20 bp, synthetic construct
  source 1..20: mol_type = other DNA
ggcgggtggcattttctttt

SEQ ID NO: 25920 - DNA, 20 bp, synthetic construct
  source 1..20: mol_type = other DNA
caccttgcagtgttaacttg

SEQ ID NO: 25921 - DNA, 20 bp, synthetic construct
  source 1..20: mol_type = other DNA
agggcaaacatcatttggcc

SEQ ID NO: 25922 - DNA, 20 bp, synthetic construct
  source 1..20: mol_type = other DNA
tcctttcttggataaacccg

SEQ ID NO: 25923 - DNA, 20 bp, synthetic construct
  source 1..20: mol_type = other DNA
gcaagactgctagccgagta

SEQ ID NO: 25924 - DNA, 20 bp, synthetic construct
  source 1..20: mol_type = other DNA
agggacctgaaagcgaaagg

SEQ ID NO: 25925 - DNA, 20 bp, synthetic construct
  source 1..20: mol_type = other DNA
tgtaacttagaagtttttca

SEQ ID NO: 25926 - DNA, 20 bp, synthetic construct
  source 1..20: mol_type = other DNA
tactgaaggtcaagcacttc

SEQ ID NO: 25927 - DNA, 20 bp, synthetic construct
  source 1..20: mol_type = other DNA
acagggcaaaaacaactgcg

SEQ ID NO: 25928 - DNA, 20 bp, synthetic construct
  source 1..20: mol_type = other DNA
ttagtagcatctttgaaatc

SEQ ID NO: 25929 - DNA, 20 bp, synthetic construct
  source 1..20: mol_type = other DNA
gtggctaaccttaaccctgc

SEQ ID NO: 25930 - DNA, 20 bp, synthetic construct
  source 1..20: mol_type = other DNA
gcggctaatcccaacctcgg

SEQ ID NO: 25931 - DNA, 20 bp, synthetic construct
  source 1..20: mol_type = other DNA
cgcatagactgttcccacgg

SEQ ID NO: 25932 - DNA, 20 bp, synthetic construct
  source 1..20: mol_type = other DNA
gtacttcgagaagcctagta

SEQ ID NO: 25933 - DNA, 20 bp, synthetic construct
  source 1..20: mol_type = other DNA
actggcgacagtggtccagg

SEQ ID NO: 25934 - DNA, 20 bp, synthetic construct
  source 1..20: mol_type = other DNA
gagagtcctccggcccctga

SEQ ID NO: 25935 - DNA, 20 bp, synthetic construct
  source 1..20: mol_type = other DNA
gctgcaacccagcagccagc

SEQ ID NO: 25936 - DNA, 20 bp, synthetic construct
  source 1..20: mol_type = other DNA
attcgaatctgtaataaaag

SEQ ID NO: 25937 - DNA, 20 bp, synthetic construct
  source 1..20: mol_type = other DNA
gagaggagattttgttcgtg

SEQ ID NO: 25938 - DNA, 20 bp, synthetic construct
  source 1..20: mol_type = other DNA
atccggactgaatccgtagt

SEQ ID NO: 25939 - DNA, 20 bp, synthetic construct
  source 1..20: mol_type = other DNA
ccctggtctgagctctgtgg

SEQ ID NO: 25940 - DNA, 20 bp, synthetic construct
  source 1..20: mol_type = other DNA
cggtgatactataagtcgtg

SEQ ID NO: 25941 - DNA, 20 bp, synthetic construct
  source 1..20: mol_type = other DNA
cgtcacttgtcgacagcgcc

SEQ ID NO: 25942 - DNA, 20 bp, synthetic construct
  source 1..20: mol_type = other DNA
tatatgcattcccgcatggc

SEQ ID NO: 25943 - DNA, 20 bp, synthetic construct
  source 1..20: mol_type = other DNA
ggtatgcgtcatcatttgcc

SEQ ID NO: 25944 - DNA, 20 bp, synthetic construct
  source 1..20: mol_type = other DNA
cgtgccgaaaatccctttgc

SEQ ID NO: 25945 - DNA, 20 bp, synthetic construct
  source 1..20: mol_type = other DNA
gcacatcttaacctgagcgg

SEQ ID NO: 25946 - DNA, 20 bp, synthetic construct
  source 1..20: mol_type = other DNA
gtggcgagctccctgggtgg

SEQ ID NO: 25947 - DNA, 20 bp, synthetic construct
  source 1..20: mol_type = other DNA
ttcaggctttagcgcgccct

SEQ ID NO: 25948 - DNA, 20 bp, synthetic construct
  source 1..20: mol_type = other DNA
tgctctggatggtgtcacca

SEQ ID NO: 25949 - DNA, 20 bp, synthetic construct
  source 1..20: mol_type = other DNA
gcgacacgcctgtggtagcg

SEQ ID NO: 25950 - DNA, 20 bp, synthetic construct
  source 1..20: mol_type = other DNA
gcaggaaccccacctgccag

SEQ ID NO: 25951 - DNA, 20 bp, synthetic construct
  source 1..20: mol_type = other DNA
caagctggttacagccctga

SEQ ID NO: 25952 - DNA, 20 bp, synthetic construct
  source 1..20: mol_type = other DNA
cagggtcaaaaattgtctaa

SEQ ID NO: 25953 - DNA, 20 bp, synthetic construct
  source 1..20: mol_type = other DNA
gagcgtttcttttccttttg

SEQ ID NO: 25954 - DNA, 20 bp, synthetic construct
  source 1..20: mol_type = other DNA
cgtttgccaatcggagggcg

SEQ ID NO: 25955 - DNA, 20 bp, synthetic construct
  source 1..20: mol_type = other DNA
cgttccactttagcaggggt

SEQ ID NO: 25956 - DNA, 20 bp, synthetic construct
  source 1..20: mol_type = other DNA
ctagccgtcgcgtcttaacg

SEQ ID NO: 25957 - DNA, 20 bp, synthetic construct
  source 1..20: mol_type = other DNA
gtttacagcacctctcacat

SEQ ID NO: 25958 - DNA, 20 bp, synthetic construct
  source 1..20: mol_type = other DNA
tagtagtatggcttagtacg

SEQ ID NO: 25959 - DNA, 20 bp, synthetic construct
  source 1..20: mol_type = other DNA
ccttgttctgaatgcacaca

SEQ ID NO: 25960 - DNA, 20 bp, synthetic construct
  source 1..20: mol_type = other DNA
cccgcacgtaaccttcagag

SEQ ID NO: 25961 - DNA, 20 bp, synthetic construct
  source 1..20: mol_type = other DNA
aggagaccgtggtgcactgc

SEQ ID NO: 25962 - DNA, 20 bp, synthetic construct
  source 1..20: mol_type = other DNA
ggcctctcacgccatccagg

SEQ ID NO: 25963 - DNA, 20 bp, synthetic construct
  source 1..20: mol_type = other DNA
tccaggggaccttgtcctac

SEQ ID NO: 25964 - DNA, 20 bp, synthetic construct
  source 1..20: mol_type = other DNA
ggtactgcgatagtgccacc

SEQ ID NO: 25965 - DNA, 20 bp, synthetic construct
  source 1..20: mol_type = other DNA
ctgactaatcagaggaacgt

SEQ ID NO: 25966 - DNA, 20 bp, synthetic construct
  source 1..20: mol_type = other DNA
agataagttagaatccaaat

SEQ ID NO: 25967 - DNA, 20 bp, synthetic construct
  source 1..20: mol_type = other DNA
gattatgtgatgctttctgc

SEQ ID NO: 25968 - DNA, 20 bp, synthetic construct
  source 1..20: mol_type = other DNA
aaaccttcttcctttttcct

SEQ ID NO: 25969 - DNA, 20 bp, synthetic construct
  source 1..20: mol_type = other DNA
ggaatatgacagggttattt

SEQ ID NO: 25970 - DNA, 20 bp, synthetic construct
  source 1..20: mol_type = other DNA
tatactgtggaagggtatgt

SEQ ID NO: 25971 - DNA, 20 bp, synthetic construct
  source 1..20: mol_type = other DNA
tgcggccaaaagccacgtgg

SEQ ID NO: 25972 - DNA, 20 bp, synthetic construct
  source 1..20: mol_type = other DNA
ctcaagcgcctctgtaggga

SEQ ID NO: 25973 - DNA, 20 bp, synthetic construct
  source 1..20: mol_type = other DNA
gggaagccaagaatgtccag

SEQ ID NO: 25974 - DNA, 20 bp, synthetic construct
  source 1..20: mol_type = other DNA
gattgggaacacttggagga

SEQ ID NO: 25975 - DNA, 20 bp, synthetic construct
  source 1..20: mol_type = other DNA
ttcgttgaacaattgtgcgt

SEQ ID NO: 25976 - DNA, 20 bp, synthetic construct
  source 1..20: mol_type = other DNA
aacaattgtgcgtattacac

SEQ ID NO: 25977 - DNA, 20 bp, synthetic construct
  source 1..20: mol_type = other DNA
aaaaattagcttaatgcatt

SEQ ID NO: 25978 - DNA, 20 bp, synthetic construct
  source 1..20: mol_type = other DNA
tggacttagacttgctctat

SEQ ID NO: 25979 - DNA, 20 bp, synthetic construct
  source 1..20: mol_type = other DNA
cagtaggacataccccaaat

SEQ ID NO: 25980 - DNA, 20 bp, synthetic construct
  source 1..20: mol_type = other DNA
ccacaaggctagtgataata

SEQ ID NO: 25981 - DNA, 20 bp, synthetic construct
  source 1..20: mol_type = other DNA
ctctagacctactggaaata

SEQ ID NO: 25982 - DNA, 20 bp, synthetic construct
  source 1..20: mol_type = other DNA
acattaagagagagagtatt

SEQ ID NO: 25983 - DNA, 20 bp, synthetic construct
  source 1..20: mol_type = other DNA
actctggtgtaaggcttaga

SEQ ID NO: 25984 - DNA, 20 bp, synthetic construct
  source 1..20: mol_type = other DNA
tttaaattttttaattccga

SEQ ID NO: 25985 - DNA, 20 bp, synthetic construct
  source 1..20: mol_type = other DNA
taaacttgaatgtaaggctt

SEQ ID NO: 25986 - DNA, 20 bp, synthetic construct
  source 1..20: mol_type = other DNA
tggtttaattgagcgcattt

SEQ ID NO: 25987 - DNA, 20 bp, synthetic construct
  source 1..20: mol_type = other DNA
aataagggagtgtcctattt

SEQ ID NO: 25988 - DNA, 20 bp, synthetic construct
  source 1..20: mol_type = other DNA
acttatgtattgatgagagc

SEQ ID NO: 25989 - DNA, 20 bp, synthetic construct
  source 1..20: mol_type = other DNA
tggaagacaatgatctgggg

SEQ ID NO: 25990 - DNA, 20 bp, synthetic construct
  source 1..20: mol_type = other DNA
tggtttgctatttagcgtac

SEQ ID NO: 25991 - DNA, 20 bp, synthetic construct
  source 1..20: mol_type = other DNA
cataggcagccccaaaaaca

SEQ ID NO: 25992 - DNA, 20 bp, synthetic construct
  source 1..20: mol_type = other DNA
tagtcaagttcgaccgtctt

SEQ ID NO: 25993 - DNA, 20 bp, synthetic construct
  source 1..20: mol_type = other DNA
cgaccgtcttctcagcgctc

SEQ ID NO: 25994 - DNA, 20 bp, synthetic construct
  source 1..20: mol_type = other DNA
ctcagcgctccgccagggcc

SEQ ID NO: 25995 - DNA, 20 bp, synthetic construct
  source 1..20: mol_type = other DNA
cgccagggccgtgggccgac

SEQ ID NO: 25996 - DNA, 20 bp, synthetic construct
  source 1..20: mol_type = other DNA
gtgggccgaccccggcgggg

SEQ ID NO: 25997 - DNA, 20 bp, synthetic construct
  source 1..20: mol_type = other DNA
cccggcggggccgatccgag

SEQ ID NO: 25998 - DNA, 20 bp, synthetic construct
  source 1..20: mol_type = other DNA
tcggtagtagcgacgggcgg

SEQ ID NO: 25999 - DNA, 20 bp, synthetic construct
  source 1..20: mol_type = other DNA
tgtgtacaaagggcagggac

SEQ ID NO: 26000 - DNA, 20 bp, synthetic construct
  source 1..20: mol_type = other DNA
gggcagggacttaatcaacg

SEQ ID NO: 26001 - DNA, 20 bp, synthetic construct
  source 1..20: mol_type = other DNA
caagcttatgacccgcactt

SEQ ID NO: 26002 - DNA, 20 bp, synthetic construct
  source 1..20: mol_type = other DNA
actgggaattcctcgttcat

SEQ ID NO: 26003 - DNA, 20 bp, synthetic construct
  source 1..20: mol_type = other DNA
ggggaataattgcaatcccc

SEQ ID NO: 26004 - DNA, 20 bp, synthetic construct
  source 1..20: mol_type = other DNA
gatccccatcacgaatgggg

SEQ ID NO: 26005 - DNA, 20 bp, synthetic construct
  source 1..20: mol_type = other DNA
agtcagtgtagcgcgcgtgc

SEQ ID NO: 26006 - DNA, 20 bp, synthetic construct
  source 1..20: mol_type = other DNA
agccccggacatctaagggc

SEQ ID NO: 26007 - DNA, 20 bp, synthetic construct
  source 1..20: mol_type = other DNA
atctaagggcatcacagacc

SEQ ID NO: 26008 - DNA, 20 bp, synthetic construct
  source 1..20: mol_type = other DNA
caatctcgggtggctgaacg

SEQ ID NO: 26009 - DNA, 20 bp, synthetic construct
  source 1..20: mol_type = other DNA
ccacttgtccctctaagaag

SEQ ID NO: 26010 - DNA, 20 bp, synthetic construct
  source 1..20: mol_type = other DNA
ctctaagaagttgggggacg

SEQ ID NO: 26011 - DNA, 20 bp, synthetic construct
  source 1..20: mol_type = other DNA
ttgggggacgccgaccgctc

SEQ ID NO: 26012 - DNA, 20 bp, synthetic construct
  source 1..20: mol_type = other DNA
ccaactaagaacggccatgc

SEQ ID NO: 26013 - DNA, 20 bp, synthetic construct
  source 1..20: mol_type = other DNA
accaccacccacggaatcga

SEQ ID NO: 26014 - DNA, 20 bp, synthetic construct
  source 1..20: mol_type = other DNA
tcaatctgtcaatcctgtcc

SEQ ID NO: 26015 - DNA, 20 bp, synthetic construct
  source 1..20: mol_type = other DNA
cgggtgaggtttcccgtgtt

SEQ ID NO: 26016 - DNA, 20 bp, synthetic construct
  source 1..20: mol_type = other DNA
ttcccgtgttgagtcaaatt

SEQ ID NO: 26017 - DNA, 20 bp, synthetic construct
  source 1..20: mol_type = other DNA
gagtcaaattaagccgcagg

SEQ ID NO: 26018 - DNA, 20 bp, synthetic construct
  source 1..20: mol_type = other DNA
aagccgcaggctccactcct

SEQ ID NO: 26019 - DNA, 20 bp, synthetic construct
  source 1..20: mol_type = other DNA
ttcagctttgcaaccatact

SEQ ID NO: 26020 - DNA, 20 bp, synthetic construct
  source 1..20: mol_type = other DNA
ttggtttcccggaagctgcc

SEQ ID NO: 26021 - DNA, 20 bp, synthetic construct
  source 1..20: mol_type = other DNA
ggaagctgcccggcgggtca

SEQ ID NO: 26022 - DNA, 20 bp, synthetic construct
  source 1..20: mol_type = other DNA
gccgccgcatcgccggtcgg

SEQ ID NO: 26023 - DNA, 20 bp, synthetic construct
  source 1..20: mol_type = other DNA
cgccggtcggcatcgtttat

SEQ ID NO: 26024 - DNA, 20 bp, synthetic construct
  source 1..20: mol_type = other DNA
catcgtttatggtcggaact

SEQ ID NO: 26025 - DNA, 20 bp, synthetic construct
  source 1..20: mol_type = other DNA
acgacggtatctgatcgtct

SEQ ID NO: 26026 - DNA, 20 bp, synthetic construct
  source 1..20: mol_type = other DNA
ctgatcgtcttcgaacctcc

SEQ ID NO: 26027 - DNA, 20 bp, synthetic construct
  source 1..20: mol_type = other DNA
gactttcgttcttgattaat

SEQ ID NO: 26028 - DNA, 20 bp, synthetic construct
  source 1..20: mol_type = other DNA
cttgattaatgaaaacattc

SEQ ID NO: 26029 - DNA, 20 bp, synthetic construct
  source 1..20: mol_type = other DNA
gaaaacattcttggcaaatg

SEQ ID NO: 26030 - DNA, 20 bp, synthetic construct
  source 1..20: mol_type = other DNA
ttggcaaatgctttcgctct

SEQ ID NO: 26031 - DNA, 20 bp, synthetic construct
  source 1..20: mol_type = other DNA
gcgccggtccaagaatttca

SEQ ID NO: 26032 - DNA, 20 bp, synthetic construct
  source 1..20: mol_type = other DNA
aagaatttcacctctagcgg

SEQ ID NO: 26033 - DNA, 20 bp, synthetic construct
  source 1..20: mol_type = other DNA
cgcaatacgaatgcccccgg

SEQ ID NO: 26034 - DNA, 20 bp, synthetic construct
  source 1..20: mol_type = other DNA
atgcccccggccgtccctct

SEQ ID NO: 26035 - DNA, 20 bp, synthetic construct
  source 1..20: mol_type = other DNA
ctcagttccgaaaaccaaca

SEQ ID NO: 26036 - DNA, 20 bp, synthetic construct
  source 1..20: mol_type = other DNA
aaatagaaccgcggtcctat

SEQ ID NO: 26037 - DNA, 20 bp, synthetic construct
  source 1..20: mol_type = other DNA
gcggtcctattccattattc

SEQ ID NO: 26038 - DNA, 20 bp, synthetic construct
  source 1..20: mol_type = other DNA
tccattattcctagctgcgg

SEQ ID NO: 26039 - DNA, 20 bp, synthetic construct
  source 1..20: mol_type = other DNA
ctctaattttttcaaagtaa

SEQ ID NO: 26040 - DNA, 20 bp, synthetic construct
  source 1..20: mol_type = other DNA
agagcatcgagggggcgccg

SEQ ID NO: 26041 - DNA, 20 bp, synthetic construct
  source 1..20: mol_type = other DNA
ggcggggacgggcggtggct

SEQ ID NO: 26042 - DNA, 20 bp, synthetic construct
  source 1..20: mol_type = other DNA
ggcggtggctcgcctcgcgg

SEQ ID NO: 26043 - DNA, 20 bp, synthetic construct
  source 1..20: mol_type = other DNA
cgcctcgcgggggaccgccc

SEQ ID NO: 26044 - DNA, 20 bp, synthetic construct
  source 1..20: mol_type = other DNA
gggaccgcccgcccgctccc

SEQ ID NO: 26045 - DNA, 20 bp, synthetic construct
  source 1..20: mol_type = other DNA
ggagctggaattaccgcggc

SEQ ID NO: 26046 - DNA, 20 bp, synthetic construct
  source 1..20: mol_type = other DNA
agacttgccctccaatggat

SEQ ID NO: 26047 - DNA, 20 bp, synthetic construct
  source 1..20: mol_type = other DNA
tccaatggatcctcgttaaa

SEQ ID NO: 26048 - DNA, 20 bp, synthetic construct
  source 1..20: mol_type = other DNA
tggactcattccaattacag

SEQ ID NO: 26049 - DNA, 20 bp, synthetic construct
  source 1..20: mol_type = other DNA
ccaattacagggcctcgaaa

SEQ ID NO: 26050 - DNA, 20 bp, synthetic construct
  source 1..20: mol_type = other DNA
ctccccgggtcgggagtggg

SEQ ID NO: 26051 - DNA, 20 bp, synthetic construct
  source 1..20: mol_type = other DNA
gcctgctgccttccttggat

SEQ ID NO: 26052 - DNA, 20 bp, synthetic construct
  source 1..20: mol_type = other DNA
ctgattccccgtcacccgtg

SEQ ID NO: 26053 - DNA, 20 bp, synthetic construct
  source 1..20: mol_type = other DNA
taggcacggcgactaccatc

SEQ ID NO: 26054 - DNA, 20 bp, synthetic construct
  source 1..20: mol_type = other DNA
gactaccatcgaaagttgat

SEQ ID NO: 26055 - DNA, 20 bp, synthetic construct
  source 1..20: mol_type = other DNA
agggcagacgttcgaatggg

SEQ ID NO: 26056 - DNA, 20 bp, synthetic construct
  source 1..20: mol_type = other DNA
ccaaagccgccggcgcccgc

SEQ ID NO: 26057 - DNA, 20 bp, synthetic construct
  source 1..20: mol_type = other DNA
cccccggccggggccggaga

SEQ ID NO: 26058 - DNA, 20 bp, synthetic construct
  source 1..20: mol_type = other DNA
tcccccccgcgaagggggtc

SEQ ID NO: 26059 - DNA, 20 bp, synthetic construct
  source 1..20: mol_type = other DNA
agctctagaattaccacagt

SEQ ID NO: 26060 - DNA, 20 bp, synthetic construct
  source 1..20: mol_type = other DNA
cgaggccaaccgaggctccg

SEQ ID NO: 26061 - DNA, 20 bp, synthetic construct
  source 1..20: mol_type = other DNA
cgaggctccgcggcgctgcc

SEQ ID NO: 26062 - DNA, 20 bp, synthetic construct
  source 1..20: mol_type = other DNA
cggcgctgccgtatcgttcc

SEQ ID NO: 26063 - DNA, 20 bp, synthetic construct
  source 1..20: mol_type = other DNA
gattctgacttagaggcgtt

SEQ ID NO: 26064 - DNA, 20 bp, synthetic construct
  source 1..20: mol_type = other DNA
tagaggcgttcagtcataat

SEQ ID NO: 26065 - DNA, 20 bp, synthetic construct
  source 1..20: mol_type = other DNA
cagtcataatcccacagatg

SEQ ID NO: 26066 - DNA, 20 bp, synthetic construct
  source 1..20: mol_type = other DNA
cccacagatggtagcttcgc

SEQ ID NO: 26067 - DNA, 20 bp, synthetic construct
  source 1..20: mol_type = other DNA
ctgagcaggattaccatggc

SEQ ID NO: 26068 - DNA, 20 bp, synthetic construct
  source 1..20: mol_type = other DNA
catcagtagggtaaaactaa

SEQ ID NO: 26069 - DNA, 20 bp, synthetic construct
  source 1..20: mol_type = other DNA
cgttccctattagtgggtga

SEQ ID NO: 26070 - DNA, 20 bp, synthetic construct
  source 1..20: mol_type = other DNA
caatgataggaagagccgac

SEQ ID NO: 26071 - DNA, 20 bp, synthetic construct
  source 1..20: mol_type = other DNA
atcgaaggatcaaaaagcga

SEQ ID NO: 26072 - DNA, 20 bp, synthetic construct
  source 1..20: mol_type = other DNA
cgtcgctatgaacgcttggc

SEQ ID NO: 26073 - DNA, 20 bp, synthetic construct
  source 1..20: mol_type = other DNA
tgtggtaacttttctgacac

SEQ ID NO: 26074 - DNA, 20 bp, synthetic construct
  source 1..20: mol_type = other DNA
aaacccaaaaggtcagaagg

SEQ ID NO: 26075 - DNA, 20 bp, synthetic construct
  source 1..20: mol_type = other DNA
cccgctttcacggtctgtat

SEQ ID NO: 26076 - DNA, 20 bp, synthetic construct
  source 1..20: mol_type = other DNA
tcgtactgaaaatcaagatc

SEQ ID NO: 26077 - DNA, 20 bp, synthetic construct
  source 1..20: mol_type = other DNA
aatcaagatcaagcgagctt

SEQ ID NO: 26078 - DNA, 20 bp, synthetic construct
  source 1..20: mol_type = other DNA
aagcgagcttttgcccttct

SEQ ID NO: 26079 - DNA, 20 bp, synthetic construct
  source 1..20: mol_type = other DNA
ttgcccttctgctccacggg

SEQ ID NO: 26080 - DNA, 20 bp, synthetic construct
  source 1..20: mol_type = other DNA
tacacctctcatgtctcttc

SEQ ID NO: 26081 - DNA, 20 bp, synthetic construct
  source 1..20: mol_type = other DNA
atgtctcttcaccgtgccag

SEQ ID NO: 26082 - DNA, 20 bp, synthetic construct
  source 1..20: mol_type = other DNA
accgtgccagactagagtca

SEQ ID NO: 26083 - DNA, 20 bp, synthetic construct
  source 1..20: mol_type = other DNA
actagagtcaagctcaacag

SEQ ID NO: 26084 - DNA, 20 bp, synthetic construct
  source 1..20: mol_type = other DNA
agctcaacagggtcttcttt

SEQ ID NO: 26085 - DNA, 20 bp, synthetic construct
  source 1..20: mol_type = other DNA
ggtcttctttccccgctgat

SEQ ID NO: 26086 - DNA, 20 bp, synthetic construct
  source 1..20: mol_type = other DNA
ccccgctgattccgccaagc

SEQ ID NO: 26087 - DNA, 20 bp, synthetic construct
  source 1..20: mol_type = other DNA
ccgttcccttggctgtggtt

SEQ ID NO: 26088 - DNA, 20 bp, synthetic construct
  source 1..20: mol_type = other DNA
tcgctggatagtaggtaggg

SEQ ID NO: 26089 - DNA, 20 bp, synthetic construct
  source 1..20: mol_type = other DNA
acagtgggaatctcgttcat

SEQ ID NO: 26090 - DNA, 20 bp, synthetic construct
  source 1..20: mol_type = other DNA
tctcgttcatccattcatgc

SEQ ID NO: 26091 - DNA, 20 bp, synthetic construct
  source 1..20: mol_type = other DNA
ccattcatgcgcgtcactaa

SEQ ID NO: 26092 - DNA, 20 bp, synthetic construct
  source 1..20: mol_type = other DNA
gcgtcactaattagatgacg

SEQ ID NO: 26093 - DNA, 20 bp, synthetic construct
  source 1..20: mol_type = other DNA
agagtcatagttactcccgc

SEQ ID NO: 26094 - DNA, 20 bp, synthetic construct
  source 1..20: mol_type = other DNA
cgcttcattgaatttcttca

SEQ ID NO: 26095 - DNA, 20 bp, synthetic construct
  source 1..20: mol_type = other DNA
aatttcttcactttgacatt

SEQ ID NO: 26096 - DNA, 20 bp, synthetic construct
  source 1..20: mol_type = other DNA
ctttgacattcagagcactg

SEQ ID NO: 26097 - DNA, 20 bp, synthetic construct
  source 1..20: mol_type = other DNA
cgccccagcccgaccgaccc

SEQ ID NO: 26098 - DNA, 20 bp, synthetic construct
  source 1..20: mol_type = other DNA
cgaccgacccagcccttaga

SEQ ID NO: 26099 - DNA, 20 bp, synthetic construct
  source 1..20: mol_type = other DNA
atcccgaagttacggatccg

SEQ ID NO: 26100 - DNA, 20 bp, synthetic construct
  source 1..20: mol_type = other DNA
tacggatccggcttgccgac

SEQ ID NO: 26101 - DNA, 20 bp, synthetic construct
  source 1..20: mol_type = other DNA
gcttgccgacttcccttacc

SEQ ID NO: 26102 - DNA, 20 bp, synthetic construct
  source 1..20: mol_type = other DNA
accttggagacctgctgcgg

SEQ ID NO: 26103 - DNA, 20 bp, synthetic construct
  source 1..20: mol_type = other DNA
atatgggtacggcccggcgc

SEQ ID NO: 26104 - DNA, 20 bp, synthetic construct
  source 1..20: mol_type = other DNA
gagatttacaccctctcccc

SEQ ID NO: 26105 - DNA, 20 bp, synthetic construct
  source 1..20: mol_type = other DNA
agggccagcgagagctcacc

SEQ ID NO: 26106 - DNA, 20 bp, synthetic construct
  source 1..20: mol_type = other DNA
agagctcaccggacgccgcc

SEQ ID NO: 26107 - DNA, 20 bp, synthetic construct
  source 1..20: mol_type = other DNA
ggacgccgccggaaccgcga

SEQ ID NO: 26108 - DNA, 20 bp, synthetic construct
  source 1..20: mol_type = other DNA
cgctttccaaggcacgggcc

SEQ ID NO: 26109 - DNA, 20 bp, synthetic construct
  source 1..20: mol_type = other DNA
cctctctcggggcgaaccca

SEQ ID NO: 26110 - DNA, 20 bp, synthetic construct
  source 1..20: mol_type = other DNA
ggcgaacccattccagggcg

SEQ ID NO: 26111 - DNA, 20 bp, synthetic construct
  source 1..20: mol_type = other DNA
cacaaagaaaagagaactct

SEQ ID NO: 26112 - DNA, 20 bp, synthetic construct
  source 1..20: mol_type = other DNA
cccgccggcttctccgggat

SEQ ID NO: 26113 - DNA, 20 bp, synthetic construct
  source 1..20: mol_type = other DNA
accgcactggacgcctcgcg

SEQ ID NO: 26114 - DNA, 20 bp, synthetic construct
  source 1..20: mol_type = other DNA
acgcctcgcggcgcccatct

SEQ ID NO: 26115 - DNA, 20 bp, synthetic construct
  source 1..20: mol_type = other DNA
gcgcccatctccgccactcc

SEQ ID NO: 26116 - DNA, 20 bp, synthetic construct
  source 1..20: mol_type = other DNA
ccgccactccggattcgggg

SEQ ID NO: 26117 - DNA, 20 bp, synthetic construct
  source 1..20: mol_type = other DNA
ggaacggcgctcgcccatct

SEQ ID NO: 26118 - DNA, 20 bp, synthetic construct
  source 1..20: mol_type = other DNA
tcgcccatctctcaggaccg

SEQ ID NO: 26119 - DNA, 20 bp, synthetic construct
  source 1..20: mol_type = other DNA
actgacccatgttcaactgc

SEQ ID NO: 26120 - DNA, 20 bp, synthetic construct
  source 1..20: mol_type = other DNA
gttcaactgctgttcacatg

SEQ ID NO: 26121 - DNA, 20 bp, synthetic construct
  source 1..20: mol_type = other DNA
ccacttcggccttcaaagtt

SEQ ID NO: 26122 - DNA, 20 bp, synthetic construct
  source 1..20: mol_type = other DNA
taccaccaagatctgcacct

SEQ ID NO: 26123 - DNA, 20 bp, synthetic construct
  source 1..20: mol_type = other DNA
gcggcggctccacccgggcc

SEQ ID NO: 26124 - DNA, 20 bp, synthetic construct
  source 1..20: mol_type = other DNA
ggccctcctactcgtcgcgg

SEQ ID NO: 26125 - DNA, 20 bp, synthetic construct
  source 1..20: mol_type = other DNA
gccgctcccgtccactctcg

SEQ ID NO: 26126 - DNA, 20 bp, synthetic construct
  source 1..20: mol_type = other DNA
acggccgggtatgggcccga

SEQ ID NO: 26127 - DNA, 20 bp, synthetic construct
  source 1..20: mol_type = other DNA
cgctccagcgccatccattt

SEQ ID NO: 26128 - DNA, 20 bp, synthetic construct
  source 1..20: mol_type = other DNA
ccatccattttcagggctag

SEQ ID NO: 26129 - DNA, 20 bp, synthetic construct
  source 1..20: mol_type = other DNA
tcagggctagttgattcggc

SEQ ID NO: 26130 - DNA, 20 bp, synthetic construct
  source 1..20: mol_type = other DNA
ttacacactccttagcggat

SEQ ID NO: 26131 - DNA, 20 bp, synthetic construct
  source 1..20: mol_type = other DNA
cttagcggattccgacttcc

SEQ ID NO: 26132 - DNA, 20 bp, synthetic construct
  source 1..20: mol_type = other DNA
atggccaccgtcctgctgtc

SEQ ID NO: 26133 - DNA, 20 bp, synthetic construct
  source 1..20: mol_type = other DNA
aacaccttttctggggtctg

SEQ ID NO: 26134 - DNA, 20 bp, synthetic construct
  source 1..20: mol_type = other DNA
ccttaacccggcgttcggtt

SEQ ID NO: 26135 - DNA, 20 bp, synthetic construct
  source 1..20: mol_type = other DNA
gcgttcggttcatcccgcag

SEQ ID NO: 26136 - DNA, 20 bp, synthetic construct
  source 1..20: mol_type = other DNA
catcccgcagcgccagttct

SEQ ID NO: 26137 - DNA, 20 bp, synthetic construct
  source 1..20: mol_type = other DNA
gcttaccaaaagtggcccac

SEQ ID NO: 26138 - DNA, 20 bp, synthetic construct
  source 1..20: mol_type = other DNA
taggcactcgcattccacgc

SEQ ID NO: 26139 - DNA, 20 bp, synthetic construct
  source 1..20: mol_type = other DNA
acccatttaaagtttgagaa

SEQ ID NO: 26140 - DNA, 20 bp, synthetic construct
  source 1..20: mol_type = other DNA
taggttgagatcgtttcggc

SEQ ID NO: 26141 - DNA, 20 bp, synthetic construct
  source 1..20: mol_type = other DNA
tcgtttcggccccaagacct

SEQ ID NO: 26142 - DNA, 20 bp, synthetic construct
  source 1..20: mol_type = other DNA
cccaagacctctaatcattc

SEQ ID NO: 26143 - DNA, 20 bp, synthetic construct
  source 1..20: mol_type = other DNA
ctaatcattcgctttaccgg

SEQ ID NO: 26144 - DNA, 20 bp, synthetic construct
  source 1..20: mol_type = other DNA
gctttaccggataaaactgc

SEQ ID NO: 26145 - DNA, 20 bp, synthetic construct
  source 1..20: mol_type = other DNA
ataaaactgcgtggcggggg

SEQ ID NO: 26146 - DNA, 20 bp, synthetic construct
  source 1..20: mol_type = other DNA
tgcgtcgggtctgcgagagc

SEQ ID NO: 26147 - DNA, 20 bp, synthetic construct
  source 1..20: mol_type = other DNA
ctgcgagagcgccagctatc

SEQ ID NO: 26148 - DNA, 20 bp, synthetic construct
  source 1..20: mol_type = other DNA
gccagctatcctgagggaaa

SEQ ID NO: 26149 - DNA, 20 bp, synthetic construct
  source 1..20: mol_type = other DNA
ctgagggaaacttcggaggg

SEQ ID NO: 26150 - DNA, 20 bp, synthetic construct
  source 1..20: mol_type = other DNA
tcgcccctatacccaggtcg

SEQ ID NO: 26151 - DNA, 20 bp, synthetic construct
  source 1..20: mol_type = other DNA
gacgaccgatttgcacgtca

SEQ ID NO: 26152 - DNA, 20 bp, synthetic construct
  source 1..20: mol_type = other DNA
ggaccgctacggacctccac

SEQ ID NO: 26153 - DNA, 20 bp, synthetic construct
  source 1..20: mol_type = other DNA
cagagtttcctctggcttcg

SEQ ID NO: 26154 - DNA, 20 bp, synthetic construct
  source 1..20: mol_type = other DNA
tctggcttcgccctgcccag

SEQ ID NO: 26155 - DNA, 20 bp, synthetic construct
  source 1..20: mol_type = other DNA
tgctccacctccccggcgcg

SEQ ID NO: 26156 - DNA, 20 bp, synthetic construct
  source 1..20: mol_type = other DNA
tcggccggcgagcgcgccgg

SEQ ID NO: 26157 - DNA, 20 bp, synthetic construct
  source 1..20: mol_type = other DNA
ccttcaccttcattgcgcca

SEQ ID NO: 26158 - DNA, 20 bp, synthetic construct
  source 1..20: mol_type = other DNA
cggcggctttcgtgcgagcc

SEQ ID NO: 26159 - DNA, 20 bp, synthetic construct
  source 1..20: mol_type = other DNA
gcacgtgttagactccttgg

SEQ ID NO: 26160 - DNA, 20 bp, synthetic construct
  source 1..20: mol_type = other DNA
ggtggcccggcccccccacg

SEQ ID NO: 26161 - DNA, 20 bp, synthetic construct
  source 1..20: mol_type = other DNA
tgggcgccgggaggggggag

SEQ ID NO: 26162 - DNA, 20 bp, synthetic construct
  source 1..20: mol_type = other DNA
gcgagtgctgctgccggggg

SEQ ID NO: 26163 - DNA, 20 bp, synthetic construct
  source 1..20: mol_type = other DNA
acgcggggccggggggcgga

SEQ ID NO: 26164 - DNA, 20 bp, synthetic construct
  source 1..20: mol_type = other DNA
ggcgggaaagatccgccggg

SEQ ID NO: 26165 - DNA, 20 bp, synthetic construct
  source 1..20: mol_type = other DNA
gccgccgggttgaatcctcc

SEQ ID NO: 26166 - DNA, 20 bp, synthetic construct
  source 1..20: mol_type = other DNA
acccgtttacctcttaacgg

SEQ ID NO: 26167 - DNA, 20 bp, synthetic construct
  source 1..20: mol_type = other DNA
ctcttaacggtttcacgccc

SEQ ID NO: 26168 - DNA, 20 bp, synthetic construct
  source 1..20: mol_type = other DNA
tcttgaactctctcttcaaa

SEQ ID NO: 26169 - DNA, 20 bp, synthetic construct
  source 1..20: mol_type = other DNA
gttcttttcaactttccctt

SEQ ID NO: 26170 - DNA, 20 bp, synthetic construct
  source 1..20: mol_type = other DNA
actttcccttacggtacttg

SEQ ID NO: 26171 - DNA, 20 bp, synthetic construct
  source 1..20: mol_type = other DNA
acggtacttgttgactatcg

SEQ ID NO: 26172 - DNA, 20 bp, synthetic construct
  source 1..20: mol_type = other DNA
gtttaccacccgctttgggc

SEQ ID NO: 26173 - DNA, 20 bp, synthetic construct
  source 1..20: mol_type = other DNA
cgctttgggctgcattccca

SEQ ID NO: 26174 - DNA, 20 bp, synthetic construct
  source 1..20: mol_type = other DNA
acccgggccccgcgcgccgg

SEQ ID NO: 26175 - DNA, 20 bp, synthetic construct
  source 1..20: mol_type = other DNA
cgcgcgccgggggccgctac

SEQ ID NO: 26176 - DNA, 20 bp, synthetic construct
  source 1..20: mol_type = other DNA
gatcagaaggacttgggccc

SEQ ID NO: 26177 - DNA, 20 bp, synthetic construct
  source 1..20: mol_type = other DNA
cccacgagcggcgccgggga

SEQ ID NO: 26178 - DNA, 20 bp, synthetic construct
  source 1..20: mol_type = other DNA
cgtacgccacatgtcccgcg

SEQ ID NO: 26179 - DNA, 20 bp, synthetic construct
  source 1..20: mol_type = other DNA
atgtcccgcgccccgccgcg

SEQ ID NO: 26180 - DNA, 20 bp, synthetic construct
  source 1..20: mol_type = other DNA
aacattccgcgctaccgagt

SEQ ID NO: 26181 - DNA, 20 bp, synthetic construct
  source 1..20: mol_type = other DNA
tatctcgcttctgttatttt

SEQ ID NO: 26182 - DNA, 20 bp, synthetic construct
  source 1..20: mol_type = other DNA
cctgtgagggctacctgtgc

SEQ ID NO: 26183 - DNA, 20 bp, synthetic construct
  source 1..20: mol_type = other DNA
agtggagtcttgggagcgct

SEQ ID NO: 26184 - DNA, 20 bp, synthetic construct
  source 1..20: mol_type = other DNA
tgcaagagtaccatttgtcg

SEQ ID NO: 26185 - DNA, 20 bp, synthetic construct
  source 1..20: mol_type = other DNA
ttagattcctgaagcttctg

SEQ ID NO: 26186 - DNA, 20 bp, synthetic construct
  source 1..20: mol_type = other DNA
tggattcgccgccgtcctgc

SEQ ID NO: 26187 - DNA, 20 bp, synthetic construct
  source 1..20: mol_type = other DNA
gctgggtcctgtttactccc

SEQ ID NO: 26188 - DNA, 20 bp, synthetic construct
  source 1..20: mol_type = other DNA
ccttgtaagaacacagccag

SEQ ID NO: 26189 - DNA, 20 bp, synthetic construct
  source 1..20: mol_type = other DNA
ctgagtcgcgtggcaggccg

SEQ ID NO: 26190 - DNA, 20 bp, synthetic construct
  source 1..20: mol_type = other DNA
cctctgcccgtgctgctgct

SEQ ID NO: 26191 - DNA, 20 bp, synthetic construct
  source 1..20: mol_type = other DNA
gtcctgggaccacatgggga

SEQ ID NO: 26192 - DNA, 20 bp, synthetic construct
  source 1..20: mol_type = other DNA
agacctgcccccgctcttgc

SEQ ID NO: 26193 - DNA, 20 bp, synthetic construct
  source 1..20: mol_type = other DNA
agtgcctgaggcagagactg

SEQ ID NO: 26194 - DNA, 20 bp, synthetic construct
  source 1..20: mol_type = other DNA
tgaacttccaaccgtatgta

SEQ ID NO: 26195 - DNA, 20 bp, synthetic construct
  source 1..20: mol_type = other DNA
gcaggcccgatttgttgaag

SEQ ID NO: 26196 - DNA, 20 bp, synthetic construct
  source 1..20: mol_type = other DNA
gtgtgtgtgtgtgtgcatgc

SEQ ID NO: 26197 - DNA, 20 bp, synthetic construct
  source 1..20: mol_type = other DNA
tcaatcgggtactccctcca

SEQ ID NO: 26198 - DNA, 20 bp, synthetic construct
  source 1..20: mol_type = other DNA
aacttcctctttcaacaaca

SEQ ID NO: 26199 - DNA, 20 bp, synthetic construct
  source 1..20: mol_type = other DNA
gccatgctgctcttcctcct

SEQ ID NO: 26200 - DNA, 20 bp, synthetic construct
  source 1..20: mol_type = other DNA
gacaaagccacgccttgccc

SEQ ID NO: 26201 - DNA, 20 bp, synthetic construct
  source 1..20: mol_type = other DNA
acccgaaaggccggacctac

SEQ ID NO: 26202 - DNA, 20 bp, synthetic construct
  source 1..20: mol_type = other DNA
gagatccgctgtcccttgag

SEQ ID NO: 26203 - DNA, 20 bp, synthetic construct
  source 1..20: mol_type = other DNA
cctgccccgaactgcccacg

SEQ ID NO: 26204 - DNA, 20 bp, synthetic construct
  source 1..20: mol_type = other DNA
acaaagctcccgctgccatt

SEQ ID NO: 26205 - DNA, 20 bp, synthetic construct
  source 1..20: mol_type = other DNA
agcggctctttcagcattgg

SEQ ID NO: 26206 - DNA, 20 bp, synthetic construct
  source 1..20: mol_type = other DNA
aacagtggagaacctaacgt

SEQ ID NO: 26207 - DNA, 20 bp, synthetic construct
  source 1..20: mol_type = other DNA
gccccgcgcgtcctgcgccg

SEQ ID NO: 26208 - DNA, 20 bp, synthetic construct
  source 1..20: mol_type = other DNA
gatctcttggagacggcgac

SEQ ID NO: 26209 - DNA, 20 bp, synthetic construct
  source 1..20: mol_type = other DNA
tgcccgctccccagacacac

SEQ ID NO: 26210 - DNA, 20 bp, synthetic construct
  source 1..20: mol_type = other DNA
tgtgcctatccctgctgtcc

SEQ ID NO: 26211 - DNA, 20 bp, synthetic construct
  source 1..20: mol_type = other DNA
cacccgggatggagccatgt

SEQ ID NO: 26212 - DNA, 20 bp, synthetic construct
  source 1..20: mol_type = other DNA
cttccagcgaagtctactcc

SEQ ID NO: 26213 - DNA, 20 bp, synthetic construct
  source 1..20: mol_type = other DNA
ggcccagcctctcctctgtc

SEQ ID NO: 26214 - DNA, 20 bp, synthetic construct
  source 1..20: mol_type = other DNA
ttggagacgtagaaccgtta

SEQ ID NO: 26215 - DNA, 20 bp, synthetic construct
  source 1..20: mol_type = other DNA
cggctggcagaagggggtga

SEQ ID NO: 26216 - DNA, 20 bp, synthetic construct
  source 1..20: mol_type = other DNA
gcggcgctgagcgggtcccc

SEQ ID NO: 26217 - DNA, 20 bp, synthetic construct
  source 1..20: mol_type = other DNA
tagagactggacaggggaga

SEQ ID NO: 26218 - DNA, 20 bp, synthetic construct
  source 1..20: mol_type = other DNA
tatcaggttctcataccgga

SEQ ID NO: 26219 - DNA, 20 bp, synthetic construct
  source 1..20: mol_type = other DNA
gactcgcgggtatcggagct

SEQ ID NO: 26220 - DNA, 20 bp, synthetic construct
  source 1..20: mol_type = other DNA
gggagcacaagcgcttccgg

SEQ ID NO: 26221 - DNA, 20 bp, synthetic construct
  source 1..20: mol_type = other DNA
actcactgcacgccatgaac

SEQ ID NO: 26222 - DNA, 20 bp, synthetic construct
  source 1..20: mol_type = other DNA
gtctccgccggcgcccgccc

SEQ ID NO: 26223 - DNA, 20 bp, synthetic construct
  source 1..20: mol_type = other DNA
gacgaagctgccggccaatg

SEQ ID NO: 26224 - DNA, 20 bp, synthetic construct
  source 1..20: mol_type = other DNA
tcgcgggctcagctggttgg

SEQ ID NO: 26225 - DNA, 20 bp, synthetic construct
  source 1..20: mol_type = other DNA
cgcggctgcggtacggcgtg

SEQ ID NO: 26226 - DNA, 20 bp, synthetic construct
  source 1..20: mol_type = other DNA
gtgcgcggctgcggtacggc

SEQ ID NO: 26227 - DNA, 20 bp, synthetic construct
  source 1..20: mol_type = other DNA
caccggcccttacactgtgg

SEQ ID NO: 26228 - DNA, 20 bp, synthetic construct
  source 1..20: mol_type = other DNA
gagccccgagagacgccccg

SEQ ID NO: 26229 - DNA, 20 bp, synthetic construct
  source 1..20: mol_type = other DNA
cgccgacagcccgagaaacc

SEQ ID NO: 26230 - DNA, 20 bp, synthetic construct
  source 1..20: mol_type = other DNA
cgcagccacgggatgggtcg

SEQ ID NO: 26231 - DNA, 20 bp, synthetic construct
  source 1..20: mol_type = other DNA
tcatcggccaccccagaagc

SEQ ID NO: 26232 - DNA, 20 bp, synthetic construct
  source 1..20: mol_type = other DNA
actgggcggggagaccaagg

SEQ ID NO: 26233 - DNA, 20 bp, synthetic construct
  source 1..20: mol_type = other DNA
cgctggcgctctactcgtgc

SEQ ID NO: 26234 - DNA, 20 bp, synthetic construct
  source 1..20: mol_type = other DNA
ccagcgccgccgaagcagct

SEQ ID NO: 26235 - DNA, 20 bp, synthetic construct
  source 1..20: mol_type = other DNA
cctccaccggcccttgcagg

SEQ ID NO: 26236 - DNA, 20 bp, synthetic construct
  source 1..20: mol_type = other DNA
ctccaggccacgcgagccgg

SEQ ID NO: 26237 - DNA, 20 bp, synthetic construct
  source 1..20: mol_type = other DNA
ccgcgggtgtgagcgcgcgc

SEQ ID NO: 26238 - DNA, 20 bp, synthetic construct
  source 1..20: mol_type = other DNA
ccctctgaccccagcccgga

SEQ ID NO: 26239 - DNA, 20 bp, synthetic construct
  source 1..20: mol_type = other DNA
gacagggagcttccttggct

SEQ ID NO: 26240 - DNA, 20 bp, synthetic construct
  source 1..20: mol_type = other DNA
ctgggcagctgggcactggg

SEQ ID NO: 26241 - DNA, 20 bp, synthetic construct
  source 1..20: mol_type = other DNA
ttgttccctatcctgggcca

SEQ ID NO: 26242 - DNA, 20 bp, synthetic construct
  source 1..20: mol_type = other DNA
ccgggtccgggccattttcc

SEQ ID NO: 26243 - DNA, 20 bp, synthetic construct
  source 1..20: mol_type = other DNA
ttctgcagtcggcgctccct

SEQ ID NO: 26244 - DNA, 20 bp, synthetic construct
  source 1..20: mol_type = other DNA
ttgctgccctcacagacttg

SEQ ID NO: 26245 - DNA, 20 bp, synthetic construct
  source 1..20: mol_type = other DNA
tgatccacttcctcctcagg

SEQ ID NO: 26246 - DNA, 20 bp, synthetic construct
  source 1..20: mol_type = other DNA
caccggcggtaccagtaagt

SEQ ID NO: 26247 - DNA, 20 bp, synthetic construct
  source 1..20: mol_type = other DNA
gaaagccgccggcggggaat

SEQ ID NO: 26248 - DNA, 20 bp, synthetic construct
  source 1..20: mol_type = other DNA
actggggatcccgccgccgg

SEQ ID NO: 26249 - DNA, 20 bp, synthetic construct
  source 1..20: mol_type = other DNA
ctgtgttgaacggttcttgt

SEQ ID NO: 26250 - DNA, 20 bp, synthetic construct
  source 1..20: mol_type = other DNA
ggctcaccatggaccgccgg

SEQ ID NO: 26251 - DNA, 20 bp, synthetic construct
  source 1..20: mol_type = other DNA
cctgagccgggaccgctagg

SEQ ID NO: 26252 - DNA, 20 bp, synthetic construct
  source 1..20: mol_type = other DNA
accggccgccgggcctctgg

SEQ ID NO: 26253 - DNA, 20 bp, synthetic construct
  source 1..20: mol_type = other DNA
aggaggtgccggccgagcac

SEQ ID NO: 26254 - DNA, 20 bp, synthetic construct
  source 1..20: mol_type = other DNA
aaatagtgagatttccaatg

SEQ ID NO: 26255 - DNA, 20 bp, synthetic construct
  source 1..20: mol_type = other DNA
tctgcaccgtcatctcctgc

SEQ ID NO: 26256 - DNA, 20 bp, synthetic construct
  source 1..20: mol_type = other DNA
ccctgagagtctgagcgctc

SEQ ID NO: 26257 - DNA, 20 bp, synthetic construct
  source 1..20: mol_type = other DNA
gtaaagcgccacgcaagcag

SEQ ID NO: 26258 - DNA, 20 bp, synthetic construct
  source 1..20: mol_type = other DNA
gccgccgcctgccgcgcccc

SEQ ID NO: 26259 - DNA, 20 bp, synthetic construct
  source 1..20: mol_type = other DNA
tttttggatagggttgacgt

SEQ ID NO: 26260 - DNA, 20 bp, synthetic construct
  source 1..20: mol_type = other DNA
gggctgcgcgcgcttttggg

SEQ ID NO: 26261 - DNA, 20 bp, synthetic construct
  source 1..20: mol_type = other DNA
tccaccggcggcaaggctcc

SEQ ID NO: 26262 - DNA, 20 bp, synthetic construct
  source 1..20: mol_type = other DNA
cagccaccggttccttatcc

SEQ ID NO: 26263 - DNA, 20 bp, synthetic construct
  source 1..20: mol_type = other DNA
taactaggtggagtaggtgt

SEQ ID NO: 26264 - DNA, 20 bp, synthetic construct
  source 1..20: mol_type = other DNA
ctctccctctttcataccca

SEQ ID NO: 26265 - DNA, 20 bp, synthetic construct
  source 1..20: mol_type = other DNA
ccgttatttaatacctgtca

SEQ ID NO: 26266 - DNA, 20 bp, synthetic construct
  source 1..20: mol_type = other DNA
gtggccactgttggcttctg

SEQ ID NO: 26267 - DNA, 20 bp, synthetic construct
  source 1..20: mol_type = other DNA
ccagcacccagactccagca

SEQ ID NO: 26268 - DNA, 20 bp, synthetic construct
  source 1..20: mol_type = other DNA
cgcccggctgctcctcactt

SEQ ID NO: 26269 - DNA, 20 bp, synthetic construct
  source 1..20: mol_type = other DNA
gtggcggcgggcggcgggcg

SEQ ID NO: 26270 - DNA, 20 bp, synthetic construct
  source 1..20: mol_type = other DNA
gggaaacatctgccgttggt

SEQ ID NO: 26271 - DNA, 20 bp, synthetic construct
  source 1..20: mol_type = other DNA
cggtagctgccccctgagct

SEQ ID NO: 26272 - DNA, 20 bp, synthetic construct
  source 1..20: mol_type = other DNA
cagcacctcctgagaccggc

SEQ ID NO: 26273 - DNA, 20 bp, synthetic construct
  source 1..20: mol_type = other DNA
cgaaactctcagggttggca

SEQ ID NO: 26274 - DNA, 20 bp, synthetic construct
  source 1..20: mol_type = other DNA
cgtgttcgcgcctggtagag

SEQ ID NO: 26275 - DNA, 20 bp, synthetic construct
  source 1..20: mol_type = other DNA
cgcggggtccaagatggtgg

SEQ ID NO: 26276 - DNA, 20 bp, synthetic construct
  source 1..20: mol_type = other DNA
ggggtgagcgtccccgtccc

SEQ ID NO: 26277 - DNA, 20 bp, synthetic construct
  source 1..20: mol_type = other DNA
ggcgttatttttattaactg

SEQ ID NO: 26278 - DNA, 20 bp, synthetic construct
  source 1..20: mol_type = other DNA
cgcgtctcttcgccacattc

SEQ ID NO: 26279 - DNA, 20 bp, synthetic construct
  source 1..20: mol_type = other DNA
cccggccgtgcgcccagctt

SEQ ID NO: 26280 - DNA, 20 bp, synthetic construct
  source 1..20: mol_type = other DNA
ccctctcctataaagcagac

SEQ ID NO: 26281 - DNA, 20 bp, synthetic construct
  source 1..20: mol_type = other DNA
tggggtgcttggggcgcacc

SEQ ID NO: 26282 - DNA, 20 bp, synthetic construct
  source 1..20: mol_type = other DNA
ccccgcgccgcccgcgcccc

SEQ ID NO: 26283 - DNA, 20 bp, synthetic construct
  source 1..20: mol_type = other DNA
tctccaggcagcggccgtcg

SEQ ID NO: 26284 - DNA, 20 bp, synthetic construct
  source 1..20: mol_type = other DNA
gcttataacctgggatgggc

SEQ ID NO: 26285 - DNA, 20 bp, synthetic construct
  source 1..20: mol_type = other DNA
ctcaggaccctcgccatgaa

SEQ ID NO: 26286 - DNA, 20 bp, synthetic construct
  source 1..20: mol_type = other DNA
cccccatgtagaaggtgcac

SEQ ID NO: 26287 - DNA, 20 bp, synthetic construct
  source 1..20: mol_type = other DNA
gggatgcggggctgggaccc

SEQ ID NO: 26288 - DNA, 20 bp, synthetic construct
  source 1..20: mol_type = other DNA
cgcctcgagcggggtccgag

SEQ ID NO: 26289 - DNA, 20 bp, synthetic construct
  source 1..20: mol_type = other DNA
gcccgcctcccgcccgccct

SEQ ID NO: 26290 - DNA, 20 bp, synthetic construct
  source 1..20: mol_type = other DNA
tgggtgctgggaaggggcct

SEQ ID NO: 26291 - DNA, 20 bp, synthetic construct
  source 1..20: mol_type = other DNA
agccacagcccgacgcacgg

SEQ ID NO: 26292 - DNA, 20 bp, synthetic construct
  source 1..20: mol_type = other DNA
aagaaagacatggatgcata

SEQ ID NO: 26293 - DNA, 20 bp, synthetic construct
  source 1..20: mol_type = other DNA
aggaaaaaaaaatcccggga

SEQ ID NO: 26294 - DNA, 20 bp, synthetic construct
  source 1..20: mol_type = other DNA
gccttaagaacccggcaacc

SEQ ID NO: 26295 - DNA, 20 bp, synthetic construct
  source 1..20: mol_type = other DNA
ggaggggcggggaggtggac

SEQ ID NO: 26296 - DNA, 20 bp, synthetic construct
  source 1..20: mol_type = other DNA
atgtattgctgtgctctccg

SEQ ID NO: 26297 - DNA, 20 bp, synthetic construct
  source 1..20: mol_type = other DNA
caccttctctgcctccagtc

SEQ ID NO: 26298 - DNA, 20 bp, synthetic construct
  source 1..20: mol_type = other DNA
ctgccctgaaactctagtcg

SEQ ID NO: 26299 - DNA, 20 bp, synthetic construct
  source 1..20: mol_type = other DNA
ggtcgggtgccgtacgccga

SEQ ID NO: 26300 - DNA, 20 bp, synthetic construct
  source 1..20: mol_type = other DNA
gcccgggtgtagcgcatcac

SEQ ID NO: 26301 - DNA, 20 bp, synthetic construct
  source 1..20: mol_type = other DNA
gagaaaaccctgtcggtctt

SEQ ID NO: 26302 - DNA, 20 bp, synthetic construct
  source 1..20: mol_type = other DNA
gaggcagccgaaccctagcg

SEQ ID NO: 26303 - DNA, 20 bp, synthetic construct
  source 1..20: mol_type = other DNA
gggtgcccggccatgggctg

SEQ ID NO: 26304 - DNA, 20 bp, synthetic construct
  source 1..20: mol_type = other DNA
tgtatgggggacagcaggcg

SEQ ID NO: 26305 - DNA, 20 bp, synthetic construct
  source 1..20: mol_type = other DNA
gctggtcccctcagagggtt

SEQ ID NO: 26306 - DNA, 20 bp, synthetic construct
  source 1..20: mol_type = other DNA
ggcgttccagagagtgggga

SEQ ID NO: 26307 - DNA, 20 bp, synthetic construct
  source 1..20: mol_type = other DNA
ggggaggaggtttactcagc

SEQ ID NO: 26308 - DNA, 20 bp, synthetic construct
  source 1..20: mol_type = other DNA
acccgcaagcaagggggcgg

SEQ ID NO: 26309 - DNA, 20 bp, synthetic construct
  source 1..20: mol_type = other DNA
acatttaagtatcttcgacc

SEQ ID NO: 26310 - DNA, 20 bp, synthetic construct
  source 1..20: mol_type = other DNA
gccagcagctgcagcagcta

SEQ ID NO: 26311 - DNA, 20 bp, synthetic construct
  source 1..20: mol_type = other DNA
ctggggcgccggcgggtgcg

SEQ ID NO: 26312 - DNA, 20 bp, synthetic construct
  source 1..20: mol_type = other DNA
acacgttggactcgctgggc

SEQ ID NO: 26313 - DNA, 20 bp, synthetic construct
  source 1..20: mol_type = other DNA
ggtgcggtggcggaagtgca

SEQ ID NO: 26314 - DNA, 20 bp, synthetic construct
  source 1..20: mol_type = other DNA
gtgaaggcaaggtccctgga

SEQ ID NO: 26315 - DNA, 20 bp, synthetic construct
  source 1..20: mol_type = other DNA
aaatttctatcttcttttgt

SEQ ID NO: 26316 - DNA, 20 bp, synthetic construct
  source 1..20: mol_type = other DNA
gaaagactttctgggcaaaa

SEQ ID NO: 26317 - DNA, 20 bp, synthetic construct
  source 1..20: mol_type = other DNA
ccggagcatcctgcactgca

SEQ ID NO: 26318 - DNA, 20 bp, synthetic construct
  source 1..20: mol_type = other DNA
cgggagctggggagccaggg

SEQ ID NO: 26319 - DNA, 20 bp, synthetic construct
  source 1..20: mol_type = other DNA
ggggacagagcccctttttt

SEQ ID NO: 26320 - DNA, 20 bp, synthetic construct
  source 1..20: mol_type = other DNA
gcttcccaggcatggagaag

SEQ ID NO: 26321 - DNA, 20 bp, synthetic construct
  source 1..20: mol_type = other DNA
actttgattattggcaaata

SEQ ID NO: 26322 - DNA, 20 bp, synthetic construct
  source 1..20: mol_type = other DNA
gaggtgcaggcagagcagcc

SEQ ID NO: 26323 - DNA, 20 bp, synthetic construct
  source 1..20: mol_type = other DNA
gcgtcaccaccctgcccacc

SEQ ID NO: 26324 - DNA, 20 bp, synthetic construct
  source 1..20: mol_type = other DNA
caaggactaattggtcttta

SEQ ID NO: 26325 - DNA, 20 bp, synthetic construct
  source 1..20: mol_type = other DNA
gagtccatgaaggtccccgc

SEQ ID NO: 26326 - DNA, 20 bp, synthetic construct
  source 1..20: mol_type = other DNA
tcggtggtgagaggaagcct

SEQ ID NO: 26327 - DNA, 20 bp, synthetic construct
  source 1..20: mol_type = other DNA
ccactgcgcgccagcaggtc

SEQ ID NO: 26328 - DNA, 20 bp, synthetic construct
  source 1..20: mol_type = other DNA
ccaggttgctctgatgatat

SEQ ID NO: 26329 - DNA, 20 bp, synthetic construct
  source 1..20: mol_type = other DNA
cttggactttcgccgaaagt

SEQ ID NO: 26330 - DNA, 20 bp, synthetic construct
  source 1..20: mol_type = other DNA
tacttggagcactatctgga

SEQ ID NO: 26331 - DNA, 20 bp, synthetic construct
  source 1..20: mol_type = other DNA
ttttcagagtagttcacaac

SEQ ID NO: 26332 - DNA, 20 bp, synthetic construct
  source 1..20: mol_type = other DNA
agaagaagaacccatgaagg

SEQ ID NO: 26333 - DNA, 20 bp, synthetic construct
  source 1..20: mol_type = other DNA
gaagtaccgcgagcaaggag

SEQ ID NO: 26334 - DNA, 20 bp, synthetic construct
  source 1..20: mol_type = other DNA
gcccccaggacccctgggga

SEQ ID NO: 26335 - DNA, 20 bp, synthetic construct
  source 1..20: mol_type = other DNA
agtccagaagcaagacctgt

SEQ ID NO: 26336 - DNA, 20 bp, synthetic construct
  source 1..20: mol_type = other DNA
ctcccctttctcgcccagcg

SEQ ID NO: 26337 - DNA, 20 bp, synthetic construct
  source 1..20: mol_type = other DNA
tgcggccgctgccccagggc

SEQ ID NO: 26338 - DNA, 20 bp, synthetic construct
  source 1..20: mol_type = other DNA
agtgcagccactgccgccgc

SEQ ID NO: 26339 - DNA, 20 bp, synthetic construct
  source 1..20: mol_type = other DNA
gccttttccctcgggtagta

SEQ ID NO: 26340 - DNA, 20 bp, synthetic construct
  source 1..20: mol_type = other DNA
caacgatgactcctgggaag

SEQ ID NO: 26341 - DNA, 20 bp, synthetic construct
  source 1..20: mol_type = other DNA
agccctgactacagctcttg

SEQ ID NO: 26342 - DNA, 20 bp, synthetic construct
  source 1..20: mol_type = other DNA
cggccggcctcgggcaccgg

SEQ ID NO: 26343 - DNA, 20 bp, synthetic construct
  source 1..20: mol_type = other DNA
ggcgtgtgaagataacccaa

SEQ ID NO: 26344 - DNA, 20 bp, synthetic construct
  source 1..20: mol_type = other DNA
gtacctttgcactccagcct

SEQ ID NO: 26345 - DNA, 20 bp, synthetic construct
  source 1..20: mol_type = other DNA
acgcagggctctcccaagtt

SEQ ID NO: 26346 - DNA, 20 bp, synthetic construct
  source 1..20: mol_type = other DNA
gagtgaagcatacagtcaaa

SEQ ID NO: 26347 - DNA, 20 bp, synthetic construct
  source 1..20: mol_type = other DNA
gataggagcaacatgcatgt

SEQ ID NO: 26348 - DNA, 20 bp, synthetic construct
  source 1..20: mol_type = other DNA
catccgagcatgaaacgctg

SEQ ID NO: 26349 - DNA, 20 bp, synthetic construct
  source 1..20: mol_type = other DNA
caagtgaaagagattagtcc

SEQ ID NO: 26350 - DNA, 20 bp, synthetic construct
  source 1..20: mol_type = other DNA
gcaggacccaggcagaaaag

SEQ ID NO: 26351 - DNA, 20 bp, synthetic construct
  source 1..20: mol_type = other DNA
ctgccatcttctccgcgcta

SEQ ID NO: 26352 - DNA, 20 bp, synthetic construct
  source 1..20: mol_type = other DNA
ctcccctgccctctaaaacc

SEQ ID NO: 26353 - DNA, 20 bp, synthetic construct
  source 1..20: mol_type = other DNA
cttcagagtttgaaaaaaaa

SEQ ID NO: 26354 - DNA, 20 bp, synthetic construct
  source 1..20: mol_type = other DNA
tcctttataaagcctggctc

SEQ ID NO: 26355 - DNA, 20 bp, synthetic construct
  source 1..20: mol_type = other DNA
gggctgctgtggctgttctg

SEQ ID NO: 26356 - DNA, 20 bp, synthetic construct
  source 1..20: mol_type = other DNA
gattaacagatgaccccaat

SEQ ID NO: 26357 - DNA, 20 bp, synthetic construct
  source 1..20: mol_type = other DNA
gcccatggatgagaaattga

SEQ ID NO: 26358 - DNA, 20 bp, synthetic construct
  source 1..20: mol_type = other DNA
aggagaagtaaggccctgga

SEQ ID NO: 26359 - DNA, 20 bp, synthetic construct
  source 1..20: mol_type = other DNA
ttgaggggctcttcgatgac

SEQ ID NO: 26360 - DNA, 20 bp, synthetic construct
  source 1..20: mol_type = other DNA
atgccgcctacgtgccccct

SEQ ID NO: 26361 - DNA, 20 bp, synthetic construct
  source 1..20: mol_type = other DNA
ataaagagaaagactcttat

SEQ ID NO: 26362 - DNA, 20 bp, synthetic construct
  source 1..20: mol_type = other DNA
cgttacttctgctgtggaag

SEQ ID NO: 26363 - DNA, 20 bp, synthetic construct
  source 1..20: mol_type = other DNA
gtgagaaggggagcaaggga

SEQ ID NO: 26364 - DNA, 20 bp, synthetic construct
  source 1..20: mol_type = other DNA
agatggagaggctggcccca

SEQ ID NO: 26365 - DNA, 20 bp, synthetic construct
  source 1..20: mol_type = other DNA
ctgcaggaccacctgctgga

SEQ ID NO: 26366 - DNA, 20 bp, synthetic construct
  source 1..20: mol_type = other DNA
ccaagttcaaggtcaccttc

SEQ ID NO: 26367 - DNA, 20 bp, synthetic construct
  source 1..20: mol_type = other DNA
tactatgtaaggaattgtcg

SEQ ID NO: 26368 - DNA, 20 bp, synthetic construct
  source 1..20: mol_type = other DNA
cctccttggtagggatcctc

SEQ ID NO: 26369 - DNA, 20 bp, synthetic construct
  source 1..20: mol_type = other DNA
ctccagcatggccgcctcca

SEQ ID NO: 26370 - DNA, 20 bp, synthetic construct
  source 1..20: mol_type = other DNA
gcccaccaagaagaaagcag

SEQ ID NO: 26371 - DNA, 20 bp, synthetic construct
  source 1..20: mol_type = other DNA
gagacttttctccctgaagt

SEQ ID NO: 26372 - DNA, 20 bp, synthetic construct
  source 1..20: mol_type = other DNA
gaggtgactgaagcgagcct

SEQ ID NO: 26373 - DNA, 20 bp, synthetic construct
  source 1..20: mol_type = other DNA
acggacggtggacgctggga

SEQ ID NO: 26374 - DNA, 20 bp, synthetic construct
  source 1..20: mol_type = other DNA
tccctgcaccatgccctaca

SEQ ID NO: 26375 - DNA, 20 bp, synthetic construct
  source 1..20: mol_type = other DNA
aacattttgggaggacgaag

SEQ ID NO: 26376 - DNA, 20 bp, synthetic construct
  source 1..20: mol_type = other DNA
gcaccatgtcttacagttgt

SEQ ID NO: 26377 - DNA, 20 bp, synthetic construct
  source 1..20: mol_type = other DNA
gatgggaggatgctcagggt

SEQ ID NO: 26378 - DNA, 20 bp, synthetic construct
  source 1..20: mol_type = other DNA
tgggttcgtgcgccttctac

SEQ ID NO: 26379 - DNA, 20 bp, synthetic construct
  source 1..20: mol_type = other DNA
tgctcccggtgccatgaacg

SEQ ID NO: 26380 - DNA, 20 bp, synthetic construct
  source 1..20: mol_type = other DNA
gacactccctaatgaaaaag

SEQ ID NO: 26381 - DNA, 20 bp, synthetic construct
  source 1..20: mol_type = other DNA
tcctcttgcccgcgcaggca

SEQ ID NO: 26382 - DNA, 20 bp, synthetic construct
  source 1..20: mol_type = other DNA
aaatcaaacctttgagaagc

SEQ ID NO: 26383 - DNA, 20 bp, synthetic construct
  source 1..20: mol_type = other DNA
gagggccctgcgccgccttt

SEQ ID NO: 26384 - DNA, 20 bp, synthetic construct
  source 1..20: mol_type = other DNA
gcgctggcggagacgccggc

SEQ ID NO: 26385 - DNA, 20 bp, synthetic construct
  source 1..20: mol_type = other DNA
tccttcccagccgcgcggct

SEQ ID NO: 26386 - DNA, 20 bp, synthetic construct
  source 1..20: mol_type = other DNA
tctgaaattcatcacctctc

SEQ ID NO: 26387 - DNA, 20 bp, synthetic construct
  source 1..20: mol_type = other DNA
ccgctgccgccgtcacccgc

SEQ ID NO: 26388 - DNA, 20 bp, synthetic construct
  source 1..20: mol_type = other DNA
cacatagccgagcccgacgg

SEQ ID NO: 26389 - DNA, 20 bp, synthetic construct
  source 1..20: mol_type = other DNA
ggtctgggtcggccacacag

SEQ ID NO: 26390 - DNA, 20 bp, synthetic construct
  source 1..20: mol_type = other DNA
tccacattcctctgtgggct

SEQ ID NO: 26391 - DNA, 20 bp, synthetic construct
  source 1..20: mol_type = other DNA
caacagccgacttagatgtg

SEQ ID NO: 26392 - DNA, 20 bp, synthetic construct
  source 1..20: mol_type = other DNA
aggtccggcacctgctgcgc

SEQ ID NO: 26393 - DNA, 20 bp, synthetic construct
  source 1..20: mol_type = other DNA
cgccgcgggaacgctgtcct

SEQ ID NO: 26394 - DNA, 20 bp, synthetic construct
  source 1..20: mol_type = other DNA
gatcgtctgctccctcagcc

SEQ ID NO: 26395 - DNA, 20 bp, synthetic construct
  source 1..20: mol_type = other DNA
ccaggctgggagcatcccct

SEQ ID NO: 26396 - DNA, 20 bp, synthetic construct
  source 1..20: mol_type = other DNA
cggccccacgcttcccactt

SEQ ID NO: 26397 - DNA, 20 bp, synthetic construct
  source 1..20: mol_type = other DNA
tctctgggccaggtggaacc

SEQ ID NO: 26398 - DNA, 20 bp, synthetic construct
  source 1..20: mol_type = other DNA
gtacctgcacttatttattg

SEQ ID NO: 26399 - DNA, 20 bp, synthetic construct
  source 1..20: mol_type = other DNA
ttgctggaggggctaccagg

SEQ ID NO: 26400 - DNA, 20 bp, synthetic construct
  source 1..20: mol_type = other DNA
agtaacaccatcaggtccta

SEQ ID NO: 26401 - DNA, 20 bp, synthetic construct
  source 1..20: mol_type = other DNA
ggagagactggacctaaatg

SEQ ID NO: 26402 - DNA, 20 bp, synthetic construct
  source 1..20: mol_type = other DNA
gaatatttgagattgaagat

SEQ ID NO: 26403 - DNA, 20 bp, synthetic construct
  source 1..20: mol_type = other DNA
ccagctctgagatttccagc

SEQ ID NO: 26404 - DNA, 20 bp, synthetic construct
  source 1..20: mol_type = other DNA
tccttcccctgaccagccca

SEQ ID NO: 26405 - DNA, 20 bp, synthetic construct
  source 1..20: mol_type = other DNA
ctctcagcttcagagggaaa

SEQ ID NO: 26406 - DNA, 20 bp, synthetic construct
  source 1..20: mol_type = other DNA
gaccctacagcttggggcct

SEQ ID NO: 26407 - DNA, 20 bp, synthetic construct
  source 1..20: mol_type = other DNA
gtcccgagcgcgatgacttg

SEQ ID NO: 26408 - DNA, 20 bp, synthetic construct
  source 1..20: mol_type = other DNA
aggtctgaattccagactcc

SEQ ID NO: 26409 - DNA, 20 bp, synthetic construct
  source 1..20: mol_type = other DNA
gcggatcccgagagggaaag

SEQ ID NO: 26410 - DNA, 20 bp, synthetic construct
  source 1..20: mol_type = other DNA
tccggcagcttctcgcggct

SEQ ID NO: 26411 - DNA, 20 bp, synthetic construct
  source 1..20: mol_type = other DNA
tggactccctgctgagcaag

SEQ ID NO: 26412 - DNA, 20 bp, synthetic construct
  source 1..20: mol_type = other DNA
gactgcactgcttctcccag

SEQ ID NO: 26413 - DNA, 20 bp, synthetic construct
  source 1..20: mol_type = other DNA
ccctgcccaccttcctcacc

SEQ ID NO: 26414 - DNA, 20 bp, synthetic construct
  source 1..20: mol_type = other DNA
gcccctcctccctggtttga

SEQ ID NO: 26415 - DNA, 20 bp, synthetic construct
  source 1..20: mol_type = other DNA
ctttcgtaaccgcaccacac

SEQ ID NO: 26416 - DNA, 20 bp, synthetic construct
  source 1..20: mol_type = other DNA
tcatcctaggcctcaggagc

SEQ ID NO: 26417 - DNA, 20 bp, synthetic construct
  source 1..20: mol_type = other DNA
gcggggcgctccggggaggc

SEQ ID NO: 26418 - DNA, 20 bp, synthetic construct
  source 1..20: mol_type = other DNA
accagaggctgctctgcttg

SEQ ID NO: 26419 - DNA, 20 bp, synthetic construct
  source 1..20: mol_type = other DNA
tgggctctgggcggtgccaa

SEQ ID NO: 26420 - DNA, 20 bp, synthetic construct
  source 1..20: mol_type = other DNA
ccaccatgccacccatgctg

SEQ ID NO: 26421 - DNA, 20 bp, synthetic construct
  source 1..20: mol_type = other DNA
agcaccggggcatccccggg

SEQ ID NO: 26422 - DNA, 20 bp, synthetic construct
  source 1..20: mol_type = other DNA
cctttcctctctgcctctgg

SEQ ID NO: 26423 - DNA, 20 bp, synthetic construct
  source 1..20: mol_type = other DNA
ccgcacccggttcagctcgc

SEQ ID NO: 26424 - DNA, 20 bp, synthetic construct
  source 1..20: mol_type = other DNA
ggccccttccccgcgggcgt

SEQ ID NO: 26425 - DNA, 20 bp, synthetic construct
  source 1..20: mol_type = other DNA
aacaccccagggagtgaaag

SEQ ID NO: 26426 - DNA, 20 bp, synthetic construct
  source 1..20: mol_type = other DNA
ctcaggtctgcagctgggtc

SEQ ID NO: 26427 - DNA, 20 bp, synthetic construct
  source 1..20: mol_type = other DNA
gatgggagagaaaggccagg

SEQ ID NO: 26428 - DNA, 20 bp, synthetic construct
  source 1..20: mol_type = other DNA
ggggagactctgcaggagcc

SEQ ID NO: 26429 - DNA, 20 bp, synthetic construct
  source 1..20: mol_type = other DNA
cgcggattgtgcacagttct

SEQ ID NO: 26430 - DNA, 20 bp, synthetic construct
  source 1..20: mol_type = other DNA
tggcccaaccatgcctctgt

SEQ ID NO: 26431 - DNA, 20 bp, synthetic construct
  source 1..20: mol_type = other DNA
ggcttcggccgccggggcca

SEQ ID NO: 26432 - DNA, 20 bp, synthetic construct
  source 1..20: mol_type = other DNA
tgtgtcccacccttcctagc

SEQ ID NO: 26433 - DNA, 20 bp, synthetic construct
  source 1..20: mol_type = other DNA
ggaaaagtgcccttgagcct

SEQ ID NO: 26434 - DNA, 20 bp, synthetic construct
  source 1..20: mol_type = other DNA
ctgcggacattcagggatcg

SEQ ID NO: 26435 - DNA, 20 bp, synthetic construct
  source 1..20: mol_type = other DNA
ggggtcacagctggccactg

SEQ ID NO: 26436 - DNA, 20 bp, synthetic construct
  source 1..20: mol_type = other DNA
cactctccctcgagcgccgc

SEQ ID NO: 26437 - DNA, 20 bp, synthetic construct
  source 1..20: mol_type = other DNA
caggaggactacttccagca

SEQ ID NO: 26438 - DNA, 20 bp, synthetic construct
  source 1..20: mol_type = other DNA
tacacccaccgaggcatggg

SEQ ID NO: 26439 - DNA, 20 bp, synthetic construct
  source 1..20: mol_type = other DNA
gcggatccccagccgtccct

SEQ ID NO: 26440 - DNA, 20 bp, synthetic construct
  source 1..20: mol_type = other DNA
cgcaccaccccccctcccgc

SEQ ID NO: 26441 - DNA, 20 bp, synthetic construct
  source 1..20: mol_type = other DNA
ttggctgcatttctggcctc

SEQ ID NO: 26442 - DNA, 20 bp, synthetic construct
  source 1..20: mol_type = other DNA
ctcttactccaaaaagatgg

SEQ ID NO: 26443 - DNA, 20 bp, synthetic construct
  source 1..20: mol_type = other DNA
gatggagccgttcctcagga

SEQ ID NO: 26444 - DNA, 20 bp, synthetic construct
  source 1..20: mol_type = other DNA
gtcctggccggataccgcgc

SEQ ID NO: 26445 - DNA, 20 bp, synthetic construct
  source 1..20: mol_type = other DNA
tttaacgagcagacgccccc

SEQ ID NO: 26446 - DNA, 20 bp, synthetic construct
  source 1..20: mol_type = other DNA
ctgggctgccggtgacctgg

SEQ ID NO: 26447 - DNA, 20 bp, synthetic construct
  source 1..20: mol_type = other DNA
ctcagcttcgagccgaggtg

SEQ ID NO: 26448 - DNA, 20 bp, synthetic construct
  source 1..20: mol_type = other DNA
ccgcggaggagcaggagagg

SEQ ID NO: 26449 - DNA, 20 bp, synthetic construct
  source 1..20: mol_type = other DNA
atggcgggagctccggacga

SEQ ID NO: 26450 - DNA, 20 bp, synthetic construct
  source 1..20: mol_type = other DNA
actcggattgctctccgccc

SEQ ID NO: 26451 - DNA, 20 bp, synthetic construct
  source 1..20: mol_type = other DNA
cttccgtcgctccttgccgg

SEQ ID NO: 26452 - DNA, 20 bp, synthetic construct
  source 1..20: mol_type = other DNA
ctgggagccgaggcgtcggt

SEQ ID NO: 26453 - DNA, 20 bp, synthetic construct
  source 1..20: mol_type = other DNA
gaagcagtaccttgaagaga

SEQ ID NO: 26454 - DNA, 20 bp, synthetic construct
  source 1..20: mol_type = other DNA
ccgtgtccgcgaccgcgtac

SEQ ID NO: 26455 - DNA, 20 bp, synthetic construct
  source 1..20: mol_type = other DNA
tccggcgggcgtgttgggtg

SEQ ID NO: 26456 - DNA, 20 bp, synthetic construct
  source 1..20: mol_type = other DNA
ctagcccctaaccatgggcc

SEQ ID NO: 26457 - DNA, 20 bp, synthetic construct
  source 1..20: mol_type = other DNA
cccacaggcgtgaacctgct

SEQ ID NO: 26458 - DNA, 20 bp, synthetic construct
  source 1..20: mol_type = other DNA
gccgtgccgggggctaactg

SEQ ID NO: 26459 - DNA, 20 bp, synthetic construct
  source 1..20: mol_type = other DNA
ccttggagccaccgccccct

SEQ ID NO: 26460 - DNA, 20 bp, synthetic construct
  source 1..20: mol_type = other DNA
gggactggtctgaagagacg

SEQ ID NO: 26461 - DNA, 20 bp, synthetic construct
  source 1..20: mol_type = other DNA
atgcggccgtgagccggcgg

SEQ ID NO: 26462 - DNA, 20 bp, synthetic construct
  source 1..20: mol_type = other DNA
tggataaagacctcctgaaa

SEQ ID NO: 26463 - DNA, 20 bp, synthetic construct
  source 1..20: mol_type = other DNA
caccggcaaaggctgtctag

SEQ ID NO: 26464 - DNA, 20 bp, synthetic construct
  source 1..20: mol_type = other DNA
caacaccccacccggcggga

SEQ ID NO: 26465 - DNA, 20 bp, synthetic construct
  source 1..20: mol_type = other DNA
cggtgggttcgggaacctgt

SEQ ID NO: 26466 - DNA, 20 bp, synthetic construct
  source 1..20: mol_type = other DNA
ggtccgatctggacgaacgc

SEQ ID NO: 26467 - DNA, 20 bp, synthetic construct
  source 1..20: mol_type = other DNA
cccttgacccagtggatatc

SEQ ID NO: 26468 - DNA, 20 bp, synthetic construct
  source 1..20: mol_type = other DNA
gtttcctctccgcgtactcg

SEQ ID NO: 26469 - DNA, 20 bp, synthetic construct
  source 1..20: mol_type = other DNA
gcaggcgactcctgtcccgg

SEQ ID NO: 26470 - DNA, 20 bp, synthetic construct
  source 1..20: mol_type = other DNA
ctttccttcgcgtcctgaac

SEQ ID NO: 26471 - DNA, 20 bp, synthetic construct
  source 1..20: mol_type = other DNA
ttgttgacactgcgagcact

SEQ ID NO: 26472 - DNA, 20 bp, synthetic construct
  source 1..20: mol_type = other DNA
caaggggcggccggcgagtc

SEQ ID NO: 26473 - DNA, 20 bp, synthetic construct
  source 1..20: mol_type = other DNA
cgaaggtcccggagcgttca

SEQ ID NO: 26474 - DNA, 20 bp, synthetic construct
  source 1..20: mol_type = other DNA
ttcgcacggccacaggggcg

SEQ ID NO: 26475 - DNA, 20 bp, synthetic construct
  source 1..20: mol_type = other DNA
ggtccgcgtgggcgctgggg

SEQ ID NO: 26476 - DNA, 20 bp, synthetic construct
  source 1..20: mol_type = other DNA
cttccttgaaaaacccggcg

SEQ ID NO: 26477 - DNA, 20 bp, synthetic construct
  source 1..20: mol_type = other DNA
tggagcaggcagggcagtct

SEQ ID NO: 26478 - DNA, 20 bp, synthetic construct
  source 1..20: mol_type = other DNA
gaaagggtctagccatgctg

SEQ ID NO: 26479 - DNA, 20 bp, synthetic construct
  source 1..20: mol_type = other DNA
caagtctctcctccctagcg

SEQ ID NO: 26480 - DNA, 20 bp, synthetic construct
  source 1..20: mol_type = other DNA
gagcgtcccgagacttcttc

SEQ ID NO: 26481 - DNA, 20 bp, synthetic construct
  source 1..20: mol_type = other DNA
ctgcgtgctgcagtagcgcc

SEQ ID NO: 26482 - DNA, 20 bp, synthetic construct
  source 1..20: mol_type = other DNA
gcgcaactgagaggaactga

SEQ ID NO: 26483 - DNA, 20 bp, synthetic construct
  source 1..20: mol_type = other DNA
gagctgggacgggcggcggc

SEQ ID NO: 26484 - DNA, 20 bp, synthetic construct
  source 1..20: mol_type = other DNA
gatgcagcgccccgggccct

SEQ ID NO: 26485 - DNA, 20 bp, synthetic construct
  source 1..20: mol_type = other DNA
tcagaggtaaggagaatttt

SEQ ID NO: 26486 - DNA, 20 bp, synthetic construct
  source 1..20: mol_type = other DNA
ggggcggctgtggagcctgt

SEQ ID NO: 26487 - DNA, 20 bp, synthetic construct
  source 1..20: mol_type = other DNA
gtcagagagcccgcggctta

SEQ ID NO: 26488 - DNA, 20 bp, synthetic construct
  source 1..20: mol_type = other DNA
tgtgagtgggaggcggcggc

SEQ ID NO: 26489 - DNA, 20 bp, synthetic construct
  source 1..20: mol_type = other DNA
tgtggtggtgtgagtgggag

SEQ ID NO: 26490 - DNA, 20 bp, synthetic construct
  source 1..20: mol_type = other DNA
ctcccgcgcggctgactcca

SEQ ID NO: 26491 - DNA, 20 bp, synthetic construct
  source 1..20: mol_type = other DNA
gcacggggggcgcgggagga

SEQ ID NO: 26492 - DNA, 20 bp, synthetic construct
  source 1..20: mol_type = other DNA
cgtgtgctcggcctttctgt

SEQ ID NO: 26493 - DNA, 20 bp, synthetic construct
  source 1..20: mol_type = other DNA
ctctgctgaggatggaagtg

SEQ ID NO: 26494 - DNA, 20 bp, synthetic construct
  source 1..20: mol_type = other DNA
gttttcggctctgaagaggt

SEQ ID NO: 26495 - DNA, 20 bp, synthetic construct
  source 1..20: mol_type = other DNA
gctcgggcggagctggagac

SEQ ID NO: 26496 - DNA, 20 bp, synthetic construct
  source 1..20: mol_type = other DNA
acgggtgcgtccgggcggct

SEQ ID NO: 26497 - DNA, 20 bp, synthetic construct
  source 1..20: mol_type = other DNA
ggtggctgtggcggtggcgc

SEQ ID NO: 26498 - DNA, 20 bp, synthetic construct
  source 1..20: mol_type = other DNA
gagactctgcgctccggcgg

SEQ ID NO: 26499 - DNA, 20 bp, synthetic construct
  source 1..20: mol_type = other DNA
accccgggacagtccctctc

SEQ ID NO: 26500 - DNA, 20 bp, synthetic construct
  source 1..20: mol_type = other DNA
aggcggcgcgggggctgctg

SEQ ID NO: 26501 - DNA, 20 bp, synthetic construct
  source 1..20: mol_type = other DNA
gcggctgacagcagcagcgg

SEQ ID NO: 26502 - DNA, 20 bp, synthetic construct
  source 1..20: mol_type = other DNA
tcctgggaatcttcaatcac

SEQ ID NO: 26503 - DNA, 20 bp, synthetic construct
  source 1..20: mol_type = other DNA
gtttgtctgtgtttctggac

SEQ ID NO: 26504 - DNA, 20 bp, synthetic construct
  source 1..20: mol_type = other DNA
cgaccagtgctgcgatcccg

SEQ ID NO: 26505 - DNA, 20 bp, synthetic construct
  source 1..20: mol_type = other DNA
gcacctggtgactgggaagc

SEQ ID NO: 26506 - DNA, 20 bp, synthetic construct
  source 1..20: mol_type = other DNA
tggctctttctcttcttggg

SEQ ID NO: 26507 - DNA, 20 bp, synthetic construct
  source 1..20: mol_type = other DNA
aaagagcaagcactgaggcc

SEQ ID NO: 26508 - DNA, 20 bp, synthetic construct
  source 1..20: mol_type = other DNA
acctgcgcccggaggtcgcc

SEQ ID NO: 26509 - DNA, 20 bp, synthetic construct
  source 1..20: mol_type = other DNA
tggtcttgaactcagggtcc

SEQ ID NO: 26510 - DNA, 20 bp, synthetic construct
  source 1..20: mol_type = other DNA
gcaggcgccgacgctgcggc

SEQ ID NO: 26511 - DNA, 20 bp, synthetic construct
  source 1..20: mol_type = other DNA
ccgtcgttgacgttagtcgc

SEQ ID NO: 26512 - DNA, 20 bp, synthetic construct
  source 1..20: mol_type = other DNA
cctaaacttcagcttctcag

SEQ ID NO: 26513 - DNA, 20 bp, synthetic construct
  source 1..20: mol_type = other DNA
tgtgcggggcgctgagcctg

SEQ ID NO: 26514 - DNA, 20 bp, synthetic construct
  source 1..20: mol_type = other DNA
acgcatctgcctttttttcc

SEQ ID NO: 26515 - DNA, 20 bp, synthetic construct
  source 1..20: mol_type = other DNA
aagtcagcattggcgcccct

SEQ ID NO: 26516 - DNA, 20 bp, synthetic construct
  source 1..20: mol_type = other DNA
atttgagccgctgttgagat

SEQ ID NO: 26517 - DNA, 20 bp, synthetic construct
  source 1..20: mol_type = other DNA
taaagacaaggattggatta

SEQ ID NO: 26518 - DNA, 20 bp, synthetic construct
  source 1..20: mol_type = other DNA
tggggctgggttcctctctt

SEQ ID NO: 26519 - DNA, 20 bp, synthetic construct
  source 1..20: mol_type = other DNA
gcacctagacctggggccag

SEQ ID NO: 26520 - DNA, 20 bp, synthetic construct
  source 1..20: mol_type = other DNA
caagatggcagcaatgagga

SEQ ID NO: 26521 - DNA, 20 bp, synthetic construct
  source 1..20: mol_type = other DNA
acacaccagccctcagtcac

SEQ ID NO: 26522 - DNA, 20 bp, synthetic construct
  source 1..20: mol_type = other DNA
gaaatttaccactctcctct

SEQ ID NO: 26523 - DNA, 20 bp, synthetic construct
  source 1..20: mol_type = other DNA
catttgcatggtggccctgt

SEQ ID NO: 26524 - DNA, 20 bp, synthetic construct
  source 1..20: mol_type = other DNA
agagagccagcatcttggca

SEQ ID NO: 26525 - DNA, 20 bp, synthetic construct
  source 1..20: mol_type = other DNA
tactgtggtttagggcttgg

SEQ ID NO: 26526 - DNA, 20 bp, synthetic construct
  source 1..20: mol_type = other DNA
gtgaaaactttgaggattac

SEQ ID NO: 26527 - DNA, 20 bp, synthetic construct
  source 1..20: mol_type = other DNA
gccaccctgccctgcccacc

SEQ ID NO: 26528 - DNA, 20 bp, synthetic construct
  source 1..20: mol_type = other DNA
tggcaacgcagtacacaagt

SEQ ID NO: 26529 - DNA, 20 bp, synthetic construct
  source 1..20: mol_type = other DNA
ccaaatctctttttgatttt

SEQ ID NO: 26530 - DNA, 20 bp, synthetic construct
  source 1..20: mol_type = other DNA
cttagagcttgagagtcaaa

SEQ ID NO: 26531 - DNA, 20 bp, synthetic construct
  source 1..20: mol_type = other DNA
tgcttaggctccgcggcctc

SEQ ID NO: 26532 - DNA, 20 bp, synthetic construct
  source 1..20: mol_type = other DNA
gggaacccgtgcggctggag

SEQ ID NO: 26533 - DNA, 20 bp, synthetic construct
  source 1..20: mol_type = other DNA
tttggaatctggcaaccatt

SEQ ID NO: 26534 - DNA, 20 bp, synthetic construct
  source 1..20: mol_type = other DNA
ttacaatcacaagcttttac

SEQ ID NO: 26535 - DNA, 20 bp, synthetic construct
  source 1..20: mol_type = other DNA
gagcgccggggctcccggag

SEQ ID NO: 26536 - DNA, 20 bp, synthetic construct
  source 1..20: mol_type = other DNA
cctccttggccaaggccagg

SEQ ID NO: 26537 - DNA, 20 bp, synthetic construct
  source 1..20: mol_type = other DNA
tgtatttcgggtcttgctgg

SEQ ID NO: 26538 - DNA, 20 bp, synthetic construct
  source 1..20: mol_type = other DNA
ccgggagacttccggcaggg

SEQ ID NO: 26539 - DNA, 20 bp, synthetic construct
  source 1..20: mol_type = other DNA
aatgtggagctaggatcaag

SEQ ID NO: 26540 - DNA, 20 bp, synthetic construct
  source 1..20: mol_type = other DNA
atttctgtgtgcaggcgagc

SEQ ID NO: 26541 - DNA, 20 bp, synthetic construct
  source 1..20: mol_type = other DNA
ttatcactgcacctcttgcc

SEQ ID NO: 26542 - DNA, 20 bp, synthetic construct
  source 1..20: mol_type = other DNA
gatgtggcagactttgctcc

SEQ ID NO: 26543 - DNA, 20 bp, synthetic construct
  source 1..20: mol_type = other DNA
agcgggagagacaaaagtcg

SEQ ID NO: 26544 - DNA, 20 bp, synthetic construct
  source 1..20: mol_type = other DNA
gttttctttgctaagattat

SEQ ID NO: 26545 - DNA, 20 bp, synthetic construct
  source 1..20: mol_type = other DNA
aaagtgtttgaaaatgaaca

SEQ ID NO: 26546 - DNA, 20 bp, synthetic construct
  source 1..20: mol_type = other DNA
atggctcaggttgtgcgcag

SEQ ID NO: 26547 - DNA, 20 bp, synthetic construct
  source 1..20: mol_type = other DNA
aggagacttgacagcttaaa

SEQ ID NO: 26548 - DNA, 20 bp, synthetic construct
  source 1..20: mol_type = other DNA
ggtgtcggaggagaactgtg

SEQ ID NO: 26549 - DNA, 20 bp, synthetic construct
  source 1..20: mol_type = other DNA
taactggttcggcatgttcc

SEQ ID NO: 26550 - DNA, 20 bp, synthetic construct
  source 1..20: mol_type = other DNA
ttctttgaattccgtggtcc

SEQ ID NO: 26551 - DNA, 20 bp, synthetic construct
  source 1..20: mol_type = other DNA
actctgaggagcagttggag

SEQ ID NO: 26552 - DNA, 20 bp, synthetic construct
  source 1..20: mol_type = other DNA
tgtctgctcgggacacggct

SEQ ID NO: 26553 - DNA, 20 bp, synthetic construct
  source 1..20: mol_type = other DNA
ctgtggctacaggcttcagc

SEQ ID NO: 26554 - DNA, 20 bp, synthetic construct
  source 1..20: mol_type = other DNA
gaacaaggcagcggctcctt

SEQ ID NO: 26555 - DNA, 20 bp, synthetic construct
  source 1..20: mol_type = other DNA
tctctggcttctcagccttc

SEQ ID NO: 26556 - DNA, 20 bp, synthetic construct
  source 1..20: mol_type = other DNA
acttctttccccctttgcag

SEQ ID NO: 26557 - DNA, 20 bp, synthetic construct
  source 1..20: mol_type = other DNA
tggtgggcctcttcagtcac

SEQ ID NO: 26558 - DNA, 20 bp, synthetic construct
  source 1..20: mol_type = other DNA
gcttctcctcctttggtgag

SEQ ID NO: 26559 - DNA, 20 bp, synthetic construct
  source 1..20: mol_type = other DNA
gtgaggagatggaagaggaa

SEQ ID NO: 26560 - DNA, 20 bp, synthetic construct
  source 1..20: mol_type = other DNA
tgcccgtatctatcgtggcg

SEQ ID NO: 26561 - DNA, 20 bp, synthetic construct
  source 1..20: mol_type = other DNA
agccatgaggatgcttctgc

SEQ ID NO: 26562 - DNA, 20 bp, synthetic construct
  source 1..20: mol_type = other DNA
gcatcgccgccgccagagga

SEQ ID NO: 26563 - DNA, 20 bp, synthetic construct
  source 1..20: mol_type = other DNA
ttggactccgcccgtggagc

SEQ ID NO: 26564 - DNA, 20 bp, synthetic construct
  source 1..20: mol_type = other DNA
tttctgattgataggctttg

SEQ ID NO: 26565 - DNA, 20 bp, synthetic construct
  source 1..20: mol_type = other DNA
aaaaatgagggagagagaaa

SEQ ID NO: 26566 - DNA, 20 bp, synthetic construct
  source 1..20: mol_type = other DNA
acgttggaagaagacctggc

SEQ ID NO: 26567 - DNA, 20 bp, synthetic construct
  source 1..20: mol_type = other DNA
agattggcagggataagcag

SEQ ID NO: 26568 - DNA, 20 bp, synthetic construct
  source 1..20: mol_type = other DNA
acatccaacaagatcggcgt

SEQ ID NO: 26569 - DNA, 20 bp, synthetic construct
  source 1..20: mol_type = other DNA
aactccttgtgctagctgtg

SEQ ID NO: 26570 - DNA, 20 bp, synthetic construct
  source 1..20: mol_type = other DNA
tttctgttgcgggaagctcc

SEQ ID NO: 26571 - DNA, 20 bp, synthetic construct
  source 1..20: mol_type = other DNA
ttccagtgggcctgggccca

SEQ ID NO: 26572 - DNA, 20 bp, synthetic construct
  source 1..20: mol_type = other DNA
tgttgcacctgttcctccct

SEQ ID NO: 26573 - DNA, 20 bp, synthetic construct
  source 1..20: mol_type = other DNA
tctgccttcccagtgcataa

SEQ ID NO: 26574 - DNA, 20 bp, synthetic construct
  source 1..20: mol_type = other DNA
acctcagccagagtccggga

SEQ ID NO: 26575 - DNA, 20 bp, synthetic construct
  source 1..20: mol_type = other DNA
gcaaggcagacttcgtgctg

SEQ ID NO: 26576 - DNA, 20 bp, synthetic construct
  source 1..20: mol_type = other DNA
ttcgtttcttgccagatttg

SEQ ID NO: 26577 - DNA, 20 bp, synthetic construct
  source 1..20: mol_type = other DNA
tcgaccccagccagcgcagc

SEQ ID NO: 26578 - DNA, 20 bp, synthetic construct
  source 1..20: mol_type = other DNA
taaacatggccgtcaccgac

SEQ ID NO: 26579 - DNA, 20 bp, synthetic construct
  source 1..20: mol_type = other DNA
ggacaaccttctcctgacag

SEQ ID NO: 26580 - DNA, 20 bp, synthetic construct
  source 1..20: mol_type = other DNA
ggcctggtgtgaatgctccg

SEQ ID NO: 26581 - DNA, 20 bp, synthetic construct
  source 1..20: mol_type = other DNA
cgctcgactggcctaggagc

SEQ ID NO: 26582 - DNA, 20 bp, synthetic construct
  source 1..20: mol_type = other DNA
cctttccttctgctgctact

SEQ ID NO: 26583 - DNA, 20 bp, synthetic construct
  source 1..20: mol_type = other DNA
ggagtggagcttggtttcgg

SEQ ID NO: 26584 - DNA, 20 bp, synthetic construct
  source 1..20: mol_type = other DNA
caggcacccgtgtggctgcc

SEQ ID NO: 26585 - DNA, 20 bp, synthetic construct
  source 1..20: mol_type = other DNA
cctgtctaccatgttctctg

SEQ ID NO: 26586 - DNA, 20 bp, synthetic construct
  source 1..20: mol_type = other DNA
ggctgactcaactgaaatca

SEQ ID NO: 26587 - DNA, 20 bp, synthetic construct
  source 1..20: mol_type = other DNA
gtggtctgtacaggcggcac

SEQ ID NO: 26588 - DNA, 20 bp, synthetic construct
  source 1..20: mol_type = other DNA
gcagctcatggagaggctga

SEQ ID NO: 26589 - DNA, 20 bp, synthetic construct
  source 1..20: mol_type = other DNA
taagaagccgccccaactcc

SEQ ID NO: 26590 - DNA, 20 bp, synthetic construct
  source 1..20: mol_type = other DNA
tgtatgcacaaagcagggtc

SEQ ID NO: 26591 - DNA, 20 bp, synthetic construct
  source 1..20: mol_type = other DNA
tcgttagcaccctttagcgt

SEQ ID NO: 26592 - DNA, 20 bp, synthetic construct
  source 1..20: mol_type = other DNA
acgagagatccaatgaaagt

SEQ ID NO: 26593 - DNA, 20 bp, synthetic construct
  source 1..20: mol_type = other DNA
gctaatacaacaaatagcaa

SEQ ID NO: 26594 - DNA, 20 bp, synthetic construct
  source 1..20: mol_type = other DNA
actcggcctataaacatcag

SEQ ID NO: 26595 - DNA, 20 bp, synthetic construct
  source 1..20: mol_type = other DNA
cgcatctgagccagccacgc

SEQ ID NO: 26596 - DNA, 20 bp, synthetic construct
  source 1..20: mol_type = other DNA
tagtagatggattacacggt

SEQ ID NO: 26597 - DNA, 20 bp, synthetic construct
  source 1..20: mol_type = other DNA
tcggtgtaccccccccggtg

SEQ ID NO: 26598 - DNA, 20 bp, synthetic construct
  source 1..20: mol_type = other DNA
cacgcgcggtctctgcggaa

SEQ ID NO: 26599 - DNA, 20 bp, synthetic construct
  source 1..20: mol_type = other DNA
gcacatggcggccaatctgt

SEQ ID NO: 26600 - DNA, 20 bp, synthetic construct
  source 1..20: mol_type = other DNA
agagccgcaatgctggagcc

SEQ ID NO: 26601 - DNA, 20 bp, synthetic construct
  source 1..20: mol_type = other DNA
aggccccatggagaaaggtc

SEQ ID NO: 26602 - DNA, 20 bp, synthetic construct
  source 1..20: mol_type = other DNA
cgaggggatcgcccctgaag

SEQ ID NO: 26603 - DNA, 20 bp, synthetic construct
  source 1..20: mol_type = other DNA
catggccggtcacactaaat

SEQ ID NO: 26604 - DNA, 20 bp, synthetic construct
  source 1..20: mol_type = other DNA
accattaatcctgcgacctg

SEQ ID NO: 26605 - DNA, 20 bp, synthetic construct
  source 1..20: mol_type = other DNA
cgacaagaggtgggcgacct

SEQ ID NO: 26606 - DNA, 20 bp, synthetic construct
  source 1..20: mol_type = other DNA
cctaaattacccaccccccg

SEQ ID NO: 26607 - DNA, 20 bp, synthetic construct
  source 1..20: mol_type = other DNA
tcgcccccttgtgtctttac

SEQ ID NO: 26608 - DNA, 20 bp, synthetic construct
  source 1..20: mol_type = other DNA
ccacttggcatccctcccct

SEQ ID NO: 26609 - DNA, 20 bp, synthetic construct
  source 1..20: mol_type = other DNA
attccggcgcctgcgaagca

SEQ ID NO: 26610 - DNA, 20 bp, synthetic construct
  source 1..20: mol_type = other DNA
atcgcacgactagggatggg

SEQ ID NO: 26611 - DNA, 20 bp, synthetic construct
  source 1..20: mol_type = other DNA
gggggtgcagcctcagaatg

SEQ ID NO: 26612 - DNA, 20 bp, synthetic construct
  source 1..20: mol_type = other DNA
atcacatggttgtagtatta

SEQ ID NO: 26613 - DNA, 20 bp, synthetic construct
  source 1..20: mol_type = other DNA
cagggtgtatacgttagttc

SEQ ID NO: 26614 - DNA, 20 bp, synthetic construct
  source 1..20: mol_type = other DNA
ccgcacgcggcatctgcctt

SEQ ID NO: 26615 - DNA, 20 bp, synthetic construct
  source 1..20: mol_type = other DNA
gcccccgatttgacgggcag

SEQ ID NO: 26616 - DNA, 20 bp, synthetic construct
  source 1..20: mol_type = other DNA
tagttctcctcccaggctag

SEQ ID NO: 26617 - DNA, 20 bp, synthetic construct
  source 1..20: mol_type = other DNA
ctcgaccccaaatcccctgt

SEQ ID NO: 26618 - DNA, 20 bp, synthetic construct
  source 1..20: mol_type = other DNA
ccgccacctgtgtccgtgtc

SEQ ID NO: 26619 - DNA, 20 bp, synthetic construct
  source 1..20: mol_type = other DNA
ccgtcacgccgaccagcgat

SEQ ID NO: 26620 - DNA, 20 bp, synthetic construct
  source 1..20: mol_type = other DNA
atccgctcgtcagcccaccg

SEQ ID NO: 26621 - DNA, 20 bp, synthetic construct
  source 1..20: mol_type = other DNA
acgtcgggccccccttagtc

SEQ ID NO: 26622 - DNA, 20 bp, synthetic construct
  source 1..20: mol_type = other DNA
cggtgtgctgtctggtccca

SEQ ID NO: 26623 - DNA, 20 bp, synthetic construct
  source 1..20: mol_type = other DNA
cgtgtaccccggtgcaccct

SEQ ID NO: 26624 - DNA, 20 bp, synthetic construct
  source 1..20: mol_type = other DNA
ccgcttgactaccaccaggt

SEQ ID NO: 26625 - DNA, 20 bp, synthetic construct
  source 1..20: mol_type = other DNA
ctctgctaaccgcaacgccg

SEQ ID NO: 26626 - DNA, 20 bp, synthetic construct
  source 1..20: mol_type = other DNA
ccacgttcccccagaagcga

SEQ ID NO: 26627 - DNA, 20 bp, synthetic construct
  source 1..20: mol_type = other DNA
ccacgcttccgccgcagggc

SEQ ID NO: 26628 - DNA, 20 bp, synthetic construct
  source 1..20: mol_type = other DNA
accgcgaagagacgggaaat

SEQ ID NO: 26629 - DNA, 20 bp, synthetic construct
  source 1..20: mol_type = other DNA
tgtgtttatactacgagtat

SEQ ID NO: 26630 - DNA, 20 bp, synthetic construct
  source 1..20: mol_type = other DNA
agcgctaagcgctcgtgccc

SEQ ID NO: 26631 - DNA, 20 bp, synthetic construct
  source 1..20: mol_type = other DNA
tgctttcctagtaacaatgg

SEQ ID NO: 26632 - DNA, 20 bp, synthetic construct
  source 1..20: mol_type = other DNA
agtccactcatagaatatct

SEQ ID NO: 26633 - DNA, 20 bp, synthetic construct
  source 1..20: mol_type = other DNA
tgaaatgggacctcctgcag

SEQ ID NO: 26634 - DNA, 20 bp, synthetic construct
  source 1..20: mol_type = other DNA
gagatatgcgataactaagt

SEQ ID NO: 26635 - DNA, 20 bp, synthetic construct
  source 1..20: mol_type = other DNA
gtccctgctcgagtgtcggg

SEQ ID NO: 26636 - DNA, 20 bp, synthetic construct
  source 1..20: mol_type = other DNA
ggttggcgcgtgggtccggg

SEQ ID NO: 26637 - DNA, 20 bp, synthetic construct
  source 1..20: mol_type = other DNA
cggggtctggcactagtcac

SEQ ID NO: 26638 - DNA, 20 bp, synthetic construct
  source 1..20: mol_type = other DNA
ttatacgaacccactttatt

SEQ ID NO: 26639 - DNA, 20 bp, synthetic construct
  source 1..20: mol_type = other DNA
gacaggagtgcggactttga

SEQ ID NO: 26640 - DNA, 20 bp, synthetic construct
  source 1..20: mol_type = other DNA
tgataataattaccctgtct

SEQ ID NO: 26641 - DNA, 20 bp, synthetic construct
  source 1..20: mol_type = other DNA
tgtcgtagcgtaaaacccgc

SEQ ID NO: 26642 - DNA, 20 bp, synthetic construct
  source 1..20: mol_type = other DNA
agagaagccgtaaacgaagt

SEQ ID NO: 26643 - DNA, 20 bp, synthetic construct
  source 1..20: mol_type = other DNA
ttatgtttaacttcacgaaa

SEQ ID NO: 26644 - DNA, 20 bp, synthetic construct
  source 1..20: mol_type = other DNA
ggtaatagagttatatattt

SEQ ID NO: 26645 - DNA, 20 bp, synthetic construct
  source 1..20: mol_type = other DNA
tacatcataccagaatcacc

SEQ ID NO: 26646 - DNA, 20 bp, synthetic construct
  source 1..20: mol_type = other DNA
gccacgattttggctttggt

SEQ ID NO: 26647 - DNA, 20 bp, synthetic construct
  source 1..20: mol_type = other DNA
gataaggacaaagagcatac

SEQ ID NO: 26648 - DNA, 20 bp, synthetic construct
  source 1..20: mol_type = other DNA
gcgtgctaagataggtaaga

SEQ ID NO: 26649 - DNA, 20 bp, synthetic construct
  source 1..20: mol_type = other DNA
ctttgcaccggtgtcgttgt

SEQ ID NO: 26650 - DNA, 20 bp, synthetic construct
  source 1..20: mol_type = other DNA
ctacgcgggtttctggcgaa

SEQ ID NO: 26651 - DNA, 20 bp, synthetic construct
  source 1..20: mol_type = other DNA
ccatggattgggtggcccac

SEQ ID NO: 26652 - DNA, 20 bp, synthetic construct
  source 1..20: mol_type = other DNA
caagcgcgcagcagggatcc

SEQ ID NO: 26653 - DNA, 20 bp, synthetic construct
  source 1..20: mol_type = other DNA
gaaagtgtggtggtatacgt

SEQ ID NO: 26654 - DNA, 20 bp, synthetic construct
  source 1..20: mol_type = other DNA
acccccagctctgggggcga

SEQ ID NO: 26655 - DNA, 20 bp, synthetic construct
  source 1..20: mol_type = other DNA
aagttcggtgaggttgtact

SEQ ID NO: 26656 - DNA, 20 bp, synthetic construct
  source 1..20: mol_type = other DNA
gtatctagatgatcaagagg

SEQ ID NO: 26657 - DNA, 20 bp, synthetic construct
  source 1..20: mol_type = other DNA
tagttctagcgaaatcctga

SEQ ID NO: 26658 - DNA, 20 bp, synthetic construct
  source 1..20: mol_type = other DNA
aactaacagactcaaacaag

SEQ ID NO: 26659 - DNA, 20 bp, synthetic construct
  source 1..20: mol_type = other DNA
aaggtaccccattgtatggg

SEQ ID NO: 26660 - DNA, 20 bp, synthetic construct
  source 1..20: mol_type = other DNA
agttatttttatgtcataag

SEQ ID NO: 26661 - DNA, 20 bp, synthetic construct
  source 1..20: mol_type = other DNA
aaagcgaaagggaaaccaga

SEQ ID NO: 26662 - DNA, 20 bp, synthetic construct
  source 1..20: mol_type = other DNA
actcctgttgccgtttccct

SEQ ID NO: 26663 - DNA, 20 bp, synthetic construct
  source 1..20: mol_type = other DNA
acagtacccgaagatggcag

SEQ ID NO: 26664 - DNA, 20 bp, synthetic construct
  source 1..20: mol_type = other DNA
acagccgggacgccgaggcg

SEQ ID NO: 26665 - DNA, 20 bp, synthetic construct
  source 1..20: mol_type = other DNA
gcggatgaagaagaaaaccc

SEQ ID NO: 26666 - DNA, 20 bp, synthetic construct
  source 1..20: mol_type = other DNA
ccccctcgtccaagaatgca

SEQ ID NO: 26667 - DNA, 20 bp, synthetic construct
  source 1..20: mol_type = other DNA
ggatcctgaggaggcagctg

SEQ ID NO: 26668 - DNA, 20 bp, synthetic construct
  source 1..20: mol_type = other DNA
gggtggggagttggcccaga

SEQ ID NO: 26669 - DNA, 20 bp, synthetic construct
  source 1..20: mol_type = other DNA
gccttctcagccccgccagc

SEQ ID NO: 26670 - DNA, 20 bp, synthetic construct
  source 1..20: mol_type = other DNA
ctgcagcagcctgcctgcag

SEQ ID NO: 26671 - DNA, 20 bp, synthetic construct
  source 1..20: mol_type = other DNA
ttgagttggtgggggttttg

SEQ ID NO: 26672 - DNA, 20 bp, synthetic construct
  source 1..20: mol_type = other DNA
cgaacctgtgcggctgcagg

SEQ ID NO: 26673 - DNA, 20 bp, synthetic construct
  source 1..20: mol_type = other DNA
ttgtccccgggtcttccaac

SEQ ID NO: 26674 - DNA, 20 bp, synthetic construct
  source 1..20: mol_type = other DNA
ctttgggctcgggggctccc

SEQ ID NO: 26675 - DNA, 20 bp, synthetic construct
  source 1..20: mol_type = other DNA
aaggctctggatggtgtact

SEQ ID NO: 26676 - DNA, 20 bp, synthetic construct
  source 1..20: mol_type = other DNA
aggacatttaaagctaaatt

SEQ ID NO: 26677 - DNA, 20 bp, synthetic construct
  source 1..20: mol_type = other DNA
attacgccgcttttgaaaaa

SEQ ID NO: 26678 - DNA, 20 bp, synthetic construct
  source 1..20: mol_type = other DNA
agaatgtaaaagagccagag

SEQ ID NO: 26679 - DNA, 20 bp, synthetic construct
  source 1..20: mol_type = other DNA
ccacatccaggcagcgcagg

SEQ ID NO: 26680 - DNA, 20 bp, synthetic construct
  source 1..20: mol_type = other DNA
tgccgctgcgcagcagtatc

SEQ ID NO: 26681 - DNA, 20 bp, synthetic construct
  source 1..20: mol_type = other DNA
gatctacaatttgaagtact

SEQ ID NO: 26682 - DNA, 20 bp, synthetic construct
  source 1..20: mol_type = other DNA
ataggtgaccggaggccggc

SEQ ID NO: 26683 - DNA, 20 bp, synthetic construct
  source 1..20: mol_type = other DNA
aagccgtgtattcccccgca

SEQ ID NO: 26684 - DNA, 20 bp, synthetic construct
  source 1..20: mol_type = other DNA
gtgctaaaaaatcaaaaaac

SEQ ID NO: 26685 - DNA, 20 bp, synthetic construct
  source 1..20: mol_type = other DNA
cggagagctatcgtgctgag

SEQ ID NO: 26686 - DNA, 20 bp, synthetic construct
  source 1..20: mol_type = other DNA
caaaagaatggagagaacag

SEQ ID NO: 26687 - DNA, 20 bp, synthetic construct
  source 1..20: mol_type = other DNA
caggtagttggtctatcaac

SEQ ID NO: 26688 - DNA, 20 bp, synthetic construct
  source 1..20: mol_type = other DNA
ccctcttaccaattcaaggg

SEQ ID NO: 26689 - DNA, 20 bp, synthetic construct
  source 1..20: mol_type = other DNA
gtttgcgcttgtcggcatct

SEQ ID NO: 26690 - DNA, 20 bp, synthetic construct
  source 1..20: mol_type = other DNA
ccgcacgcacccaccgggac

SEQ ID NO: 26691 - DNA, 20 bp, synthetic construct
  source 1..20: mol_type = other DNA
taacagaaatggttccggag

SEQ ID NO: 26692 - DNA, 20 bp, synthetic construct
  source 1..20: mol_type = other DNA
tgaatgcatcctgtgcagcc

SEQ ID NO: 26693 - DNA, 20 bp, synthetic construct
  source 1..20: mol_type = other DNA
ttaatgcatcctgtgcagca

SEQ ID NO: 26694 - DNA, 20 bp, synthetic construct
  source 1..20: mol_type = other DNA
ccaaggccattagaagccaa

SEQ ID NO: 26695 - DNA, 20 bp, synthetic construct
  source 1..20: mol_type = other DNA
cgaggagatctggagctgct

SEQ ID NO: 26696 - DNA, 20 bp, synthetic construct
  source 1..20: mol_type = other DNA
actcgggtggtggccgctga

SEQ ID NO: 26697 - DNA, 20 bp, synthetic construct
  source 1..20: mol_type = other DNA
tctatagacgaacgtgtcat

SEQ ID NO: 26698 - DNA, 20 bp, synthetic construct
  source 1..20: mol_type = other DNA
gtacccccgtcgttggcgtg

SEQ ID NO: 26699 - DNA, 20 bp, synthetic construct
  source 1..20: mol_type = other DNA
agtccgggactttttgaagc

SEQ ID NO: 26700 - DNA, 20 bp, synthetic construct
  source 1..20: mol_type = other DNA
acgccactcgatctcgctcc

SEQ ID NO: 26701 - DNA, 20 bp, synthetic construct
  source 1..20: mol_type = other DNA
gaatattaataaatatcttc

SEQ ID NO: 26702 - DNA, 20 bp, synthetic construct
  source 1..20: mol_type = other DNA
atggcgggaccgtcgattcc

SEQ ID NO: 26703 - DNA, 20 bp, synthetic construct
  source 1..20: mol_type = other DNA
atggcgggaccgttgattcc

SEQ ID NO: 26704 - DNA, 20 bp, synthetic construct
  source 1..20: mol_type = other DNA
tagggactgttctcttcagt

SEQ ID NO: 26705 - DNA, 20 bp, synthetic construct
  source 1..20: mol_type = other DNA
cttgcacctattaaagaggg

SEQ ID NO: 26706 - DNA, 20 bp, synthetic construct
  source 1..20: mol_type = other DNA
tcgtcggaaacgagaagaca

SEQ ID NO: 26707 - DNA, 20 bp, synthetic construct
  source 1..20: mol_type = other DNA
cggttgctgcttgctgtcct

SEQ ID NO: 26708 - DNA, 20 bp, synthetic construct
  source 1..20: mol_type = other DNA
gctttggaagcagttagatc

SEQ ID NO: 26709 - DNA, 20 bp, synthetic construct
  source 1..20: mol_type = other DNA
atgcctacctgacctcccac

SEQ ID NO: 26710 - DNA, 20 bp, synthetic construct
  source 1..20: mol_type = other DNA
ttgcaaattatttaaaaggt

SEQ ID NO: 26711 - DNA, 20 bp, synthetic construct
  source 1..20: mol_type = other DNA
agaagccaagaggaccccgg

SEQ ID NO: 26712 - DNA, 20 bp, synthetic construct
  source 1..20: mol_type = other DNA
aaataagggtgcatgagggg

SEQ ID NO: 26713 - DNA, 20 bp, synthetic construct
  source 1..20: mol_type = other DNA
agcagatctgaggacatctc

SEQ ID NO: 26714 - DNA, 20 bp, synthetic construct
  source 1..20: mol_type = other DNA
tcgatatcgtcgatcccatt

SEQ ID NO: 26715 - DNA, 20 bp, synthetic construct
  source 1..20: mol_type = other DNA
atgtaaagacttgcagatga

SEQ ID NO: 26716 - DNA, 20 bp, synthetic construct
  source 1..20: mol_type = other DNA
ggctaaaacggtttccgccc

SEQ ID NO: 26717 - DNA, 20 bp, synthetic construct
  source 1..20: mol_type = other DNA
tgacaataacatattcatcc

SEQ ID NO: 26718 - DNA, 20 bp, synthetic construct
  source 1..20: mol_type = other DNA
acgagcaacaccggctcttt

SEQ ID NO: 26719 - DNA, 20 bp, synthetic construct
  source 1..20: mol_type = other DNA
gtacctttttgctcacacca

SEQ ID NO: 26720 - DNA, 20 bp, synthetic construct
  source 1..20: mol_type = other DNA
ttccgtgtagaagggcacac

SEQ ID NO: 26721 - DNA, 20 bp, synthetic construct
  source 1..20: mol_type = other DNA
ggttgaaggtatcttcagac

SEQ ID NO: 26722 - DNA, 20 bp, synthetic construct
  source 1..20: mol_type = other DNA
cgtgtgtcggtcgcctagtc

SEQ ID NO: 26723 - DNA, 20 bp, synthetic construct
  source 1..20: mol_type = other DNA
ttctatctatcccggccata

SEQ ID NO: 26724 - DNA, 20 bp, synthetic construct
  source 1..20: mol_type = other DNA
tatgactactgacaatctta

SEQ ID NO: 26725 - DNA, 20 bp, synthetic construct
  source 1..20: mol_type = other DNA
cagatggagaggagaaaacc

SEQ ID NO: 26726 - DNA, 20 bp, synthetic construct
  source 1..20: mol_type = other DNA
ccagcggtcataaaagaatt

SEQ ID NO: 26727 - DNA, 20 bp, synthetic construct
  source 1..20: mol_type = other DNA
ccccacgcactacgtgccgg

SEQ ID NO: 26728 - DNA, 20 bp, synthetic construct
  source 1..20: mol_type = other DNA
cagaagtttggacagctcaa

SEQ ID NO: 26729 - DNA, 20 bp, synthetic construct
  source 1..20: mol_type = other DNA
tggctcgggaggcaactcag

SEQ ID NO: 26730 - DNA, 20 bp, synthetic construct
  source 1..20: mol_type = other DNA
ctatccacgctatcattgct

SEQ ID NO: 26731 - DNA, 20 bp, synthetic construct
  source 1..20: mol_type = other DNA
acaaaagatatggacccgca

SEQ ID NO: 26732 - DNA, 20 bp, synthetic construct
  source 1..20: mol_type = other DNA
acatgtgtgaaaggcgagcc

SEQ ID NO: 26733 - DNA, 20 bp, synthetic construct
  source 1..20: mol_type = other DNA
tgtgcgaataactatgagga

SEQ ID NO: 26734 - DNA, 20 bp, synthetic construct
  source 1..20: mol_type = other DNA
gaagtagcagctcacacgcc

SEQ ID NO: 26735 - DNA, 20 bp, synthetic construct
  source 1..20: mol_type = other DNA
aagatgtcaatatgggtgca

SEQ ID NO: 26736 - DNA, 20 bp, synthetic construct
  source 1..20: mol_type = other DNA
cctttgggggctacctgtac

SEQ ID NO: 26737 - DNA, 20 bp, synthetic construct
  source 1..20: mol_type = other DNA
cccacgggggttacttgcac

SEQ ID NO: 26738 - DNA, 20 bp, synthetic construct
  source 1..20: mol_type = other DNA
gccaagtgtgtttgaagaac

SEQ ID NO: 26739 - DNA, 20 bp, synthetic construct
  source 1..20: mol_type = other DNA
tgcttctgattgtgaacgtt

SEQ ID NO: 26740 - DNA, 20 bp, synthetic construct
  source 1..20: mol_type = other DNA
gtccgtgtttcttttgttca

SEQ ID NO: 26741 - DNA, 20 bp, synthetic construct
  source 1..20: mol_type = other DNA
atccttgcgaccacgttggc

SEQ ID NO: 26742 - DNA, 20 bp, synthetic construct
  source 1..20: mol_type = other DNA
acgtggggagctcaactggt

SEQ ID NO: 26743 - DNA, 20 bp, synthetic construct
  source 1..20: mol_type = other DNA
ggtgttcgggtatgaggctg

SEQ ID NO: 26744 - DNA, 20 bp, synthetic construct
  source 1..20: mol_type = other DNA
ttcacgctcaccgtgcccag

SEQ ID NO: 26745 - DNA, 20 bp, synthetic construct
  source 1..20: mol_type = other DNA
aaaaaccttaaaggctggtc

SEQ ID NO: 26746 - DNA, 20 bp, synthetic construct
  source 1..20: mol_type = other DNA
tgtgtcaagctttcaggtag

SEQ ID NO: 26747 - DNA, 20 bp, synthetic construct
  source 1..20: mol_type = other DNA
aaatcatggcgtcccaaggc

SEQ ID NO: 26748 - DNA, 20 bp, synthetic construct
  source 1..20: mol_type = other DNA
gacaatgcttcaacccgatg

SEQ ID NO: 26749 - DNA, 20 bp, synthetic construct
  source 1..20: mol_type = other DNA
tcagctaggacaacaacagc

SEQ ID NO: 26750 - DNA, 20 bp, synthetic construct
  source 1..20: mol_type = other DNA
gggcgagcatcgggtcatcg

SEQ ID NO: 26751 - DNA, 20 bp, synthetic construct
  source 1..20: mol_type = other DNA
agactctgaggcaggacagg

SEQ ID NO: 26752 - DNA, 20 bp, synthetic construct
  source 1..20: mol_type = other DNA
gcagttccgctggctagtgt

SEQ ID NO: 26753 - DNA, 20 bp, synthetic construct
  source 1..20: mol_type = other DNA
caatgatctggagtgtcccg

SEQ ID NO: 26754 - DNA, 20 bp, synthetic construct
  source 1..20: mol_type = other DNA
ggaagcaaattggaaatgac

SEQ ID NO: 26755 - DNA, 20 bp, synthetic construct
  source 1..20: mol_type = other DNA
ggatcaacgtggaccgcatt

SEQ ID NO: 26756 - DNA, 20 bp, synthetic construct
  source 1..20: mol_type = other DNA
acggctggatgggacactag

SEQ ID NO: 26757 - DNA, 20 bp, synthetic construct
  source 1..20: mol_type = other DNA
gccggcggtgctccttctgc

SEQ ID NO: 26758 - DNA, 20 bp, synthetic construct
  source 1..20: mol_type = other DNA
gtagtggtaagaaagcgcca

SEQ ID NO: 26759 - DNA, 20 bp, synthetic construct
  source 1..20: mol_type = other DNA
tggatccactactctcgact

SEQ ID NO: 26760 - DNA, 20 bp, synthetic construct
  source 1..20: mol_type = other DNA
gcagcctagcactagaaggc

SEQ ID NO: 26761 - DNA, 20 bp, synthetic construct
  source 1..20: mol_type = other DNA
ctcggtgcgcttgtcatttc

SEQ ID NO: 26762 - DNA, 20 bp, synthetic construct
  source 1..20: mol_type = other DNA
gcgctagcgatacgctcgac

SEQ ID NO: 26763 - DNA, 20 bp, synthetic construct
  source 1..20: mol_type = other DNA
ctcgatatcttcgacgatag

SEQ ID NO: 26764 - DNA, 20 bp, synthetic construct
  source 1..20: mol_type = other DNA
cagagtcgcaattgacaata

SEQ ID NO: 26765 - DNA, 20 bp, synthetic construct
  source 1..20: mol_type = other DNA
agtgcggatttctatcgaag

SEQ ID NO: 26766 - DNA, 20 bp, synthetic construct
  source 1..20: mol_type = other DNA
ggactgctctgccggggcgg

SEQ ID NO: 26767 - DNA, 20 bp, synthetic construct
  source 1..20: mol_type = other DNA
gagtcgcgggacccccggtt

SEQ ID NO: 26768 - DNA, 20 bp, synthetic construct
  source 1..20: mol_type = other DNA
ccgttctctgtgggctcaaa

SEQ ID NO: 26769 - DNA, 20 bp, synthetic construct
  source 1..20: mol_type = other DNA
gcatagtctcgccgcgcgtc

SEQ ID NO: 26770 - DNA, 20 bp, synthetic construct
  source 1..20: mol_type = other DNA
cgaatcaaccctatctactg

SEQ ID NO: 26771 - DNA, 20 bp, synthetic construct
  source 1..20: mol_type = other DNA
ttctgtcatttgtctgttca

SEQ ID NO: 26772 - DNA, 20 bp, synthetic construct
  source 1..20: mol_type = other DNA
ataccaaacttcgacgcaat

SEQ ID NO: 26773 - DNA, 20 bp, synthetic construct
  source 1..20: mol_type = other DNA
acgtggttgctggtcaggaa

SEQ ID NO: 26774 - DNA, 20 bp, synthetic construct
  source 1..20: mol_type = other DNA
gtatccaataaaccctcttg

SEQ ID NO: 26775 - DNA, 20 bp, synthetic construct
  source 1..20: mol_type = other DNA
tgataatctcgcggtggaga

SEQ ID NO: 26776 - DNA, 20 bp, synthetic construct
  source 1..20: mol_type = other DNA
tctttcttggtttggtgctt

SEQ ID NO: 26777 - DNA, 20 bp, synthetic construct
  source 1..20: mol_type = other DNA
gtcgcgccgcgcgttctttc

SEQ ID NO: 26778 - DNA, 20 bp, synthetic construct
  source 1..20: mol_type = other DNA
ccccaaaccaagtggtcttg

SEQ ID NO: 26779 - DNA, 20 bp, synthetic construct
  source 1..20: mol_type = other DNA
cggaggctctcttcagtaaa

SEQ ID NO: 26780 - DNA, 20 bp, synthetic construct
  source 1..20: mol_type = other DNA
acatggacgaaccctggccc

SEQ ID NO: 26781 - DNA, 20 bp, synthetic construct
  source 1..20: mol_type = other DNA
aatttccaccaagtggagac

SEQ ID NO: 26782 - DNA, 20 bp, synthetic construct
  source 1..20: mol_type = other DNA
attctcggtatccatgtcgc

SEQ ID NO: 26783 - DNA, 20 bp, synthetic construct
  source 1..20: mol_type = other DNA
tcccctgcctttggcgcctt

SEQ ID NO: 26784 - DNA, 20 bp, synthetic construct
  source 1..20: mol_type = other DNA
cttcgcacaccgcgacgctc

SEQ ID NO: 26785 - DNA, 20 bp, synthetic construct
  source 1..20: mol_type = other DNA
catcacccagggcacgatcc

SEQ ID NO: 26786 - DNA, 20 bp, synthetic construct
  source 1..20: mol_type = other DNA
gggtgctggtcaccggggca

SEQ ID NO: 26787 - DNA, 20 bp, synthetic construct
  source 1..20: mol_type = other DNA
gccggttgctgagccgggag

SEQ ID NO: 26788 - DNA, 20 bp, synthetic construct
  source 1..20: mol_type = other DNA
aacatggacttcccgtgcct

SEQ ID NO: 26789 - DNA, 20 bp, synthetic construct
  source 1..20: mol_type = other DNA
atggacgtatctagtggttc

SEQ ID NO: 26790 - DNA, 20 bp, synthetic construct
  source 1..20: mol_type = other DNA
agacggcagcgaactcgtcg

SEQ ID NO: 26791 - DNA, 20 bp, synthetic construct
  source 1..20: mol_type = other DNA
ctacagcgggggagacattt

SEQ ID NO: 26792 - DNA, 20 bp, synthetic construct
  source 1..20: mol_type = other DNA
tcatcaacacaattttgaat

SEQ ID NO: 26793 - DNA, 20 bp, synthetic construct
  source 1..20: mol_type = other DNA
tccgcgtcgctagctagtcg

SEQ ID NO: 26794 - DNA, 20 bp, synthetic construct
  source 1..20: mol_type = other DNA
ccgtaccctaagatacgggg

SEQ ID NO: 26795 - DNA, 20 bp, synthetic construct
  source 1..20: mol_type = other DNA
agaataaatttgcaggtcaa

SEQ ID NO: 26796 - DNA, 20 bp, synthetic construct
  source 1..20: mol_type = other DNA
tatctcttgctggaaaaatc

SEQ ID NO: 26797 - DNA, 20 bp, synthetic construct
  source 1..20: mol_type = other DNA
cacgcgcttttgtatcagag

SEQ ID NO: 26798 - DNA, 20 bp, synthetic construct
  source 1..20: mol_type = other DNA
ttccccatccccttcccaac

SEQ ID NO: 26799 - DNA, 20 bp, synthetic construct
  source 1..20: mol_type = other DNA
cgcgcgcctttgtctcagag

SEQ ID NO: 26800 - DNA, 20 bp, synthetic construct
  source 1..20: mol_type = other DNA
gaactctgcaatttattgag

SEQ ID NO: 26801 - DNA, 20 bp, synthetic construct
  source 1..20: mol_type = other DNA
cccttgcgagtgaacaccac

SEQ ID NO: 26802 - DNA, 20 bp, synthetic construct
  source 1..20: mol_type = other DNA
gcctgtctggccctgttgct

SEQ ID NO: 26803 - DNA, 20 bp, synthetic construct
  source 1..20: mol_type = other DNA
cagcttaatcaactgacccg

SEQ ID NO: 26804 - DNA, 20 bp, synthetic construct
  source 1..20: mol_type = other DNA
cgctgtctccctggagttct

SEQ ID NO: 26805 - DNA, 20 bp, synthetic construct
  source 1..20: mol_type = other DNA
ttccagcagttggggccacg

SEQ ID NO: 26806 - DNA, 20 bp, synthetic construct
  source 1..20: mol_type = other DNA
gggagagttgggagagtaaa

SEQ ID NO: 26807 - DNA, 20 bp, synthetic construct
  source 1..20: mol_type = other DNA
ggatctggataaagatacat

SEQ ID NO: 26808 - DNA, 20 bp, synthetic construct
  source 1..20: mol_type = other DNA
gcctaaaagagcaaggacta

SEQ ID NO: 26809 - DNA, 20 bp, synthetic construct
  source 1..20: mol_type = other DNA
attttccggcccaggctaag

SEQ ID NO: 26810 - DNA, 20 bp, synthetic construct
  source 1..20: mol_type = other DNA
aagagtgtgttctgccaggg

SEQ ID NO: 26811 - DNA, 20 bp, synthetic construct
  source 1..20: mol_type = other DNA
gaagggctattgcaacaccc

SEQ ID NO: 26812 - DNA, 20 bp, synthetic construct
  source 1..20: mol_type = other DNA
gctgttccagtcaacgctag

SEQ ID NO: 26813 - DNA, 20 bp, synthetic construct
  source 1..20: mol_type = other DNA
gcaatctcggctgtctgtac

SEQ ID NO: 26814 - DNA, 20 bp, synthetic construct
  source 1..20: mol_type = other DNA
caggaaatttcctcctccta

SEQ ID NO: 26815 - DNA, 20 bp, synthetic construct
  source 1..20: mol_type = other DNA
cctggatctgtctgacagcg

SEQ ID NO: 26816 - DNA, 20 bp, synthetic construct
  source 1..20: mol_type = other DNA
ggcctagggctccgcttgac

SEQ ID NO: 26817 - DNA, 20 bp, synthetic construct
  source 1..20: mol_type = other DNA
acagtgacaggtatcttttt

SEQ ID NO: 26818 - DNA, 20 bp, synthetic construct
  source 1..20: mol_type = other DNA
ccctgtattaatatggggac

SEQ ID NO: 26819 - DNA, 20 bp, synthetic construct
  source 1..20: mol_type = other DNA
ttctgctacgtcattaccag

SEQ ID NO: 26820 - DNA, 20 bp, synthetic construct
  source 1..20: mol_type = other DNA
agtagcaagaccgggaatag

SEQ ID NO: 26821 - DNA, 20 bp, synthetic construct
  source 1..20: mol_type = other DNA
atctctagcatgaccagacc

SEQ ID NO: 26822 - DNA, 20 bp, synthetic construct
  source 1..20: mol_type = other DNA
tggagacaacatgtggttct

SEQ ID NO: 26823 - DNA, 20 bp, synthetic construct
  source 1..20: mol_type = other DNA
tcagtctgtgtttactctca

SEQ ID NO: 26824 - DNA, 20 bp, synthetic construct
  source 1..20: mol_type = other DNA
cgcgcacctcatggttccgg

SEQ ID NO: 26825 - DNA, 20 bp, synthetic construct
  source 1..20: mol_type = other DNA
gtggcgtagtactctggtat

SEQ ID NO: 26826 - DNA, 20 bp, synthetic construct
  source 1..20: mol_type = other DNA
aaaatcctccctgagagagc

SEQ ID NO: 26827 - DNA, 20 bp, synthetic construct
  source 1..20: mol_type = other DNA
gtggcgtagtacttggtatt

SEQ ID NO: 26828 - DNA, 20 bp, synthetic construct
  source 1..20: mol_type = other DNA
tgggcgctagcactctgatt

SEQ ID NO: 26829 - DNA, 20 bp, synthetic construct
  source 1..20: mol_type = other DNA
tgggcgctagtacactgata

SEQ ID NO: 26830 - DNA, 20 bp, synthetic construct
  source 1..20: mol_type = other DNA
gggcgctagcactctggtat

SEQ ID NO: 26831 - DNA, 20 bp, synthetic construct
  source 1..20: mol_type = other DNA
tgggcgctagtacactggta

SEQ ID NO: 26832 - DNA, 20 bp, synthetic construct
  source 1..20: mol_type = other DNA
gtgaggattaacaacaatta

SEQ ID NO: 26833 - DNA, 20 bp, synthetic construct
  source 1..20: mol_type = other DNA
ttccctccacccgcagtaac

SEQ ID NO: 26834 - DNA, 20 bp, synthetic construct
  source 1..20: mol_type = other DNA
tcacgcgttgtcgcgagctc

SEQ ID NO: 26835 - DNA, 20 bp, synthetic construct
  source 1..20: mol_type = other DNA
ttcgtctccgatgattatga

SEQ ID NO: 26836 - DNA, 20 bp, synthetic construct
  source 1..20: mol_type = other DNA
tcctcctcgcccccacccag

SEQ ID NO: 26837 - DNA, 20 bp, synthetic construct
  source 1..20: mol_type = other DNA
agagatttgaacatgagtat

SEQ ID NO: 26838 - DNA, 20 bp, synthetic construct
  source 1..20: mol_type = other DNA
gtggcggctagtactccggt

SEQ ID NO: 26839 - DNA, 20 bp, synthetic construct
  source 1..20: mol_type = other DNA
ggtcccctccacggaggacc

SEQ ID NO: 26840 - DNA, 20 bp, synthetic construct
  source 1..20: mol_type = other DNA
aatgttcatttcaagccgac

SEQ ID NO: 26841 - DNA, 20 bp, synthetic construct
  source 1..20: mol_type = other DNA
gtcaccgaaataaattcgca

SEQ ID NO: 26842 - DNA, 20 bp, synthetic construct
  source 1..20: mol_type = other DNA
ggagtggtagtgggggctgc

SEQ ID NO: 26843 - DNA, 20 bp, synthetic construct
  source 1..20: mol_type = other DNA
gagtcgcggctggccgactc

SEQ ID NO: 26844 - DNA, 20 bp, synthetic construct
  source 1..20: mol_type = other DNA
tcctgggaatcttcaatcat

SEQ ID NO: 26845 - DNA, 20 bp, synthetic construct
  source 1..20: mol_type = other DNA
ggagcaggacccataaggtt

SEQ ID NO: 26846 - DNA, 20 bp, synthetic construct
  source 1..20: mol_type = other DNA
tacttcattctgcactcaaa

SEQ ID NO: 26847 - DNA, 20 bp, synthetic construct
  source 1..20: mol_type = other DNA
gagcaactctattctagatc

SEQ ID NO: 26848 - DNA, 20 bp, synthetic construct
  source 1..20: mol_type = other DNA
tgtcattttggcagatagtc

SEQ ID NO: 26849 - DNA, 20 bp, synthetic construct
  source 1..20: mol_type = other DNA
aagttttcgacgtggtcaga

SEQ ID NO: 26850 - DNA, 20 bp, synthetic construct
  source 1..20: mol_type = other DNA
gtcacgaaggggagggaata

SEQ ID NO: 26851 - DNA, 20 bp, synthetic construct
  source 1..20: mol_type = other DNA
gtgggtggctgcccagctcg

SEQ ID NO: 26852 - DNA, 20 bp, synthetic construct
  source 1..20: mol_type = other DNA
tcttctcgactgactccatg

SEQ ID NO: 26853 - DNA, 20 bp, synthetic construct
  source 1..20: mol_type = other DNA
cgccactcttgggagaggaa

SEQ ID NO: 26854 - DNA, 20 bp, synthetic construct
  source 1..20: mol_type = other DNA
gggatgtcaaattcctggtc

SEQ ID NO: 26855 - DNA, 20 bp, synthetic construct
  source 1..20: mol_type = other DNA
ccacgggacgctagttgtga

SEQ ID NO: 26856 - DNA, 20 bp, synthetic construct
  source 1..20: mol_type = other DNA
gcgtcggagggagctctact

SEQ ID NO: 26857 - DNA, 20 bp, synthetic construct
  source 1..20: mol_type = other DNA
ggccacaatctttttgatct

SEQ ID NO: 26858 - DNA, 20 bp, synthetic construct
  source 1..20: mol_type = other DNA
cacagttgccgcggacggag

SEQ ID NO: 26859 - DNA, 20 bp, synthetic construct
  source 1..20: mol_type = other DNA
gacagctcctgcgctgcact

SEQ ID NO: 26860 - DNA, 20 bp, synthetic construct
  source 1..20: mol_type = other DNA
cgaccgtccctgcgactcac

SEQ ID NO: 26861 - DNA, 20 bp, synthetic construct
  source 1..20: mol_type = other DNA
gcagtccctgcgatacactc

SEQ ID NO: 26862 - DNA, 20 bp, synthetic construct
  source 1..20: mol_type = other DNA
cccttcattgtccccatggc

SEQ ID NO: 26863 - DNA, 20 bp, synthetic construct
  source 1..20: mol_type = other DNA
gagcgtcatctaataaagat

SEQ ID NO: 26864 - DNA, 20 bp, synthetic construct
  source 1..20: mol_type = other DNA
ttttccggtggccacccgcc

SEQ ID NO: 26865 - DNA, 20 bp, synthetic construct
  source 1..20: mol_type = other DNA
cggggccgggcaagtttgtt

SEQ ID NO: 26866 - DNA, 20 bp, synthetic construct
  source 1..20: mol_type = other DNA
ctgatccgaggctggagcca

SEQ ID NO: 26867 - DNA, 20 bp, synthetic construct
  source 1..20: mol_type = other DNA
aaggtctcgagatgccacgt

SEQ ID NO: 26868 - DNA, 20 bp, synthetic construct
  source 1..20: mol_type = other DNA
aatcaagtcatcgagatttc

SEQ ID NO: 26869 - DNA, 20 bp, synthetic construct
  source 1..20: mol_type = other DNA
gtctggcgatggttatggtc

SEQ ID NO: 26870 - DNA, 20 bp, synthetic construct
  source 1..20: mol_type = other DNA
gttctggaagacaataaccc

SEQ ID NO: 26871 - DNA, 20 bp, synthetic construct
  source 1..20: mol_type = other DNA
atgtgtatcccagaagaagc

SEQ ID NO: 26872 - DNA, 20 bp, synthetic construct
  source 1..20: mol_type = other DNA
cggaagcttgcttaacgtag

SEQ ID NO: 26873 - DNA, 20 bp, synthetic construct
  source 1..20: mol_type = other DNA
tcggagattcgcccgggccc

SEQ ID NO: 26874 - DNA, 20 bp, synthetic construct
  source 1..20: mol_type = other DNA
ttaaacttaagcgcgccgtg

SEQ ID NO: 26875 - DNA, 20 bp, synthetic construct
  source 1..20: mol_type = other DNA
cgcgtgaggctgcggctctg

SEQ ID NO: 26876 - DNA, 20 bp, synthetic construct
  source 1..20: mol_type = other DNA
gcagcgaccaacgcttctct

SEQ ID NO: 26877 - DNA, 20 bp, synthetic construct
  source 1..20: mol_type = other DNA
cagagggccagtacgtttcg

SEQ ID NO: 26878 - DNA, 20 bp, synthetic construct
  source 1..20: mol_type = other DNA
gaggcccactattaggctag

SEQ ID NO: 26879 - DNA, 20 bp, synthetic construct
  source 1..20: mol_type = other DNA
ataccgcaaccaaaatatcg

SEQ ID NO: 26880 - DNA, 20 bp, synthetic construct
  source 1..20: mol_type = other DNA
cagcgagtagagttttctct

SEQ ID NO: 26881 - DNA, 20 bp, synthetic construct
  source 1..20: mol_type = other DNA
tgcggacgcagttgcgtgag

SEQ ID NO: 26882 - DNA, 20 bp, synthetic construct
  source 1..20: mol_type = other DNA
ggaactctccagtttgtgga

SEQ ID NO: 26883 - DNA, 20 bp, synthetic construct
  source 1..20: mol_type = other DNA
gatagggtgcttgcgagtgc

SEQ ID NO: 26884 - DNA, 20 bp, synthetic construct
  source 1..20: mol_type = other DNA
accaaccgcaatggacccag

SEQ ID NO: 26885 - DNA, 20 bp, synthetic construct
  source 1..20: mol_type = other DNA
acgcagatctgtttgtcacg

SEQ ID NO: 26886 - DNA, 20 bp, synthetic construct
  source 1..20: mol_type = other DNA
tcgtcaaccgatgagatagg

SEQ ID NO: 26887 - DNA, 20 bp, synthetic construct
  source 1..20: mol_type = other DNA
aggagaagttgatttccgtg

SEQ ID NO: 26888 - DNA, 20 bp, synthetic construct
  source 1..20: mol_type = other DNA
ggggcgcgggtcactgaccc

SEQ ID NO: 26889 - DNA, 20 bp, synthetic construct
  source 1..20: mol_type = other DNA
tggacatccttaggcaaaac

SEQ ID NO: 26890 - DNA, 20 bp, synthetic construct
  source 1..20: mol_type = other DNA
agcagcagggacttaacttc

SEQ ID NO: 26891 - DNA, 20 bp, synthetic construct
  source 1..20: mol_type = other DNA
cgggggctgtagctgggttt

SEQ ID NO: 26892 - DNA, 20 bp, synthetic construct
  source 1..20: mol_type = other DNA
ccccaggctacctgacgggg

SEQ ID NO: 26893 - DNA, 20 bp, synthetic construct
  source 1..20: mol_type = other DNA
ggcggcggcagtactgggac

SEQ ID NO: 26894 - DNA, 20 bp, synthetic construct
  source 1..20: mol_type = other DNA
ctgcggtctggccttggagg

SEQ ID NO: 26895 - DNA, 20 bp, synthetic construct
  source 1..20: mol_type = other DNA
ctggggtccgacctggaagg

SEQ ID NO: 26896 - DNA, 20 bp, synthetic construct
  source 1..20: mol_type = other DNA
cctccaaagaaggaagcatc

SEQ ID NO: 26897 - DNA, 20 bp, synthetic construct
  source 1..20: mol_type = other DNA
agggcgtggtctaccaagaa

SEQ ID NO: 26898 - DNA, 20 bp, synthetic construct
  source 1..20: mol_type = other DNA
gatctcactccattgaacgt

SEQ ID NO: 26899 - DNA, 20 bp, synthetic construct
  source 1..20: mol_type = other DNA
ccttggttgatgccattgtc

SEQ ID NO: 26900 - DNA, 20 bp, synthetic construct
  source 1..20: mol_type = other DNA
caacatgatatatttgtcct

SEQ ID NO: 26901 - DNA, 20 bp, synthetic construct
  source 1..20: mol_type = other DNA
tttgaacttttatacaaaac

SEQ ID NO: 26902 - DNA, 20 bp, synthetic construct
  source 1..20: mol_type = other DNA
ttcaattgtggctttgacgt

SEQ ID NO: 26903 - DNA, 20 bp, synthetic construct
  source 1..20: mol_type = other DNA
ccgtggaccctctggtataa

SEQ ID NO: 26904 - DNA, 20 bp, synthetic construct
  source 1..20: mol_type = other DNA
agggactccagaccttccta

SEQ ID NO: 26905 - DNA, 20 bp, synthetic construct
  source 1..20: mol_type = other DNA
accaacacacactcgacgtg

SEQ ID NO: 26906 - DNA, 20 bp, synthetic construct
  source 1..20: mol_type = other DNA
ccaagaggcaaagttgtgga

SEQ ID NO: 26907 - DNA, 20 bp, synthetic construct
  source 1..20: mol_type = other DNA
agtccaaagtggaccaggcc

SEQ ID NO: 26908 - DNA, 20 bp, synthetic construct
  source 1..20: mol_type = other DNA
atatgacgcttgtttctttt

SEQ ID NO: 26909 - DNA, 20 bp, synthetic construct
  source 1..20: mol_type = other DNA
cggctagtaatgattctgga

SEQ ID NO: 26910 - DNA, 20 bp, synthetic construct
  source 1..20: mol_type = other DNA
gaggtgactgacagttacga

SEQ ID NO: 26911 - DNA, 20 bp, synthetic construct
  source 1..20: mol_type = other DNA
attgggtgcgcgactcggtt

SEQ ID NO: 26912 - DNA, 20 bp, synthetic construct
  source 1..20: mol_type = other DNA
cacgtaaaggctgccgacac

SEQ ID NO: 26913 - DNA, 20 bp, synthetic construct
  source 1..20: mol_type = other DNA
cagattctgctctgagtgtg

SEQ ID NO: 26914 - DNA, 20 bp, synthetic construct
  source 1..20: mol_type = other DNA
accgtggaacatctcgagaa

SEQ ID NO: 26915 - DNA, 20 bp, synthetic construct
  source 1..20: mol_type = other DNA
ccatcatcaacaccatcatc

SEQ ID NO: 26916 - DNA, 20 bp, synthetic construct
  source 1..20: mol_type = other DNA
tgcaatggcaacccagtcgc

SEQ ID NO: 26917 - DNA, 20 bp, synthetic construct
  source 1..20: mol_type = other DNA
caaggggagaagaaggaaga

SEQ ID NO: 26918 - DNA, 20 bp, synthetic construct
  source 1..20: mol_type = other DNA
aagaaggctttacccacttc

SEQ ID NO: 26919 - DNA, 20 bp, synthetic construct
  source 1..20: mol_type = other DNA
gtaggggaagcccccactat

SEQ ID NO: 26920 - DNA, 20 bp, synthetic construct
  source 1..20: mol_type = other DNA
cctccgcggctggccattgt

SEQ ID NO: 26921 - DNA, 20 bp, synthetic construct
  source 1..20: mol_type = other DNA
ggacctgttgggaacagatg

SEQ ID NO: 26922 - DNA, 20 bp, synthetic construct
  source 1..20: mol_type = other DNA
caaagttggcgttttattat

SEQ ID NO: 26923 - DNA, 20 bp, synthetic construct
  source 1..20: mol_type = other DNA
tgacaaggagagaagtccac

SEQ ID NO: 26924 - DNA, 20 bp, synthetic construct
  source 1..20: mol_type = other DNA
ctggtttgtttccccggtgc

SEQ ID NO: 26925 - DNA, 20 bp, synthetic construct
  source 1..20: mol_type = other DNA
gagaacagagtatcgttctg

SEQ ID NO: 26926 - DNA, 20 bp, synthetic construct
  source 1..20: mol_type = other DNA
aagtcgaaaggttaaaacat

SEQ ID NO: 26927 - DNA, 20 bp, synthetic construct
  source 1..20: mol_type = other DNA
agcaaaatgggtgtttattt

SEQ ID NO: 26928 - DNA, 20 bp, synthetic construct
  source 1..20: mol_type = other DNA
gggtaagaactgagggggca

SEQ ID NO: 26929 - DNA, 20 bp, synthetic construct
  source 1..20: mol_type = other DNA
cagaacggcggagacccagg

SEQ ID NO: 26930 - DNA, 20 bp, synthetic construct
  source 1..20: mol_type = other DNA
ggcctccttcttgataaagt

SEQ ID NO: 26931 - DNA, 20 bp, synthetic construct
  source 1..20: mol_type = other DNA
ttcgtggaacgttgttcccg

SEQ ID NO: 26932 - DNA, 20 bp, synthetic construct
  source 1..20: mol_type = other DNA
atagatgaaatagcaggagg

SEQ ID NO: 26933 - DNA, 20 bp, synthetic construct
  source 1..20: mol_type = other DNA
aggcagcgactgtgattgtg

SEQ ID NO: 26934 - DNA, 20 bp, synthetic construct
  source 1..20: mol_type = other DNA
ttctgtgtttttacgtaggt

SEQ ID NO: 26935 - DNA, 20 bp, synthetic construct
  source 1..20: mol_type = other DNA
tttccttctttcttacctta

SEQ ID NO: 26936 - DNA, 20 bp, synthetic construct
  source 1..20: mol_type = other DNA
ctcgaaagcgaaagttccag

SEQ ID NO: 26937 - DNA, 20 bp, synthetic construct
  source 1..20: mol_type = other DNA
gcgaaagcgaaagtagaacc

SEQ ID NO: 26938 - DNA, 20 bp, synthetic construct
  source 1..20: mol_type = other DNA
tcgaaagcgaaagtgttcca

SEQ ID NO: 26939 - DNA, 20 bp, synthetic construct
  source 1..20: mol_type = other DNA
ttgaaagcgaaagttccaga

SEQ ID NO: 26940 - DNA, 20 bp, synthetic construct
  source 1..20: mol_type = other DNA
ttgaaagcgacagtagaacc

SEQ ID NO: 26941 - DNA, 20 bp, synthetic construct
  source 1..20: mol_type = other DNA
gagaaagcgaaagtagaacc

SEQ ID NO: 26942 - DNA, 20 bp, synthetic construct
  source 1..20: mol_type = other DNA
ggaaagcgaaagagaaacca

SEQ ID NO: 26943 - DNA, 20 bp, synthetic construct
  source 1..20: mol_type = other DNA
tgaaagcgaaagtaccagag

SEQ ID NO: 26944 - DNA, 20 bp, synthetic construct
  source 1..20: mol_type = other DNA
cgaaagcgaaagtagaacca

SEQ ID NO: 26945 - DNA, 20 bp, synthetic construct
  source 1..20: mol_type = other DNA
cgaaagcgaaagttccagag

SEQ ID NO: 26946 - DNA, 20 bp, synthetic construct
  source 1..20: mol_type = other DNA
ggaaaagcgaaagtaaaacc

SEQ ID NO: 26947 - DNA, 20 bp, synthetic construct
  source 1..20: mol_type = other DNA
tgaaagcgaaagagaaacca

SEQ ID NO: 26948 - DNA, 20 bp, synthetic construct
  source 1..20: mol_type = other DNA
tgaaagtgaaagtagaacca

SEQ ID NO: 26949 - DNA, 20 bp, synthetic construct
  source 1..20: mol_type = other DNA
ctcgaaagcggaagttccca

SEQ ID NO: 26950 - DNA, 20 bp, synthetic construct
  source 1..20: mol_type = other DNA
gtaaaaatctctagcagtgg

SEQ ID NO: 26951 - DNA, 20 bp, synthetic construct
  source 1..20: mol_type = other DNA
ataaaaatctctagcagtgg

SEQ ID NO: 26952 - DNA, 20 bp, synthetic construct
  source 1..20: mol_type = other DNA
gtaaaattctctagcagtgg

SEQ ID NO: 26953 - DNA, 20 bp, synthetic construct
  source 1..20: mol_type = other DNA
gaaagcgaaagtagaaccag

SEQ ID NO: 26954 - DNA, 20 bp, synthetic construct
  source 1..20: mol_type = other DNA
gaaagcgaaagtaaaaccag

SEQ ID NO: 26955 - DNA, 20 bp, synthetic construct
  source 1..20: mol_type = other DNA
gaaagcgaaagtaagaccag

SEQ ID NO: 26956 - DNA, 20 bp, synthetic construct
  source 1..20: mol_type = other DNA
gaaaacgaaagtaaaaccag

SEQ ID NO: 26957 - DNA, 20 bp, synthetic construct
  source 1..20: mol_type = other DNA
gaaagcgaaagagaaaccag

SEQ ID NO: 26958 - DNA, 20 bp, synthetic construct
  source 1..20: mol_type = other DNA
gaaagcgaaagtgagaccag

SEQ ID NO: 26959 - DNA, 20 bp, synthetic construct
  source 1..20: mol_type = other DNA
gaaaacgaaagtaaactgga

SEQ ID NO: 26960 - DNA, 20 bp, synthetic construct
  source 1..20: mol_type = other DNA
gaaaacgaaagtagaaccag

SEQ ID NO: 26961 - DNA, 20 bp, synthetic construct
  source 1..20: mol_type = other DNA
gaaaacgaaagtagaaccgg

SEQ ID NO: 26962 - DNA, 20 bp, synthetic construct
  source 1..20: mol_type = other DNA
gaaagcgaaagtagaaccgg

SEQ ID NO: 26963 - DNA, 20 bp, synthetic construct
  source 1..20: mol_type = other DNA
gaaaaggaaaatgagacccg

SEQ ID NO: 26964 - DNA, 20 bp, synthetic construct
  source 1..20: mol_type = other DNA
gaaaacgaaagcggaaccgg

SEQ ID NO: 26965 - DNA, 20 bp, synthetic construct
  source 1..20: mol_type = other DNA
gaaagccaaagttagaaccc

SEQ ID NO: 26966 - DNA, 20 bp, synthetic construct
  source 1..20: mol_type = other DNA
aagaaaacctccgacgcaac

SEQ ID NO: 26967 - DNA, 20 bp, synthetic construct
  source 1..20: mol_type = other DNA
tcgaaagcgaaagttccaga

SEQ ID NO: 26968 - DNA, 20 bp, synthetic construct
  source 1..20: mol_type = other DNA
cgaaagcggaagttccagag

SEQ ID NO: 26969 - DNA, 20 bp, synthetic construct
  source 1..20: mol_type = other DNA
taaaaatctctagcagtggc

SEQ ID NO: 26970 - DNA, 20 bp, synthetic construct
  source 1..20: mol_type = other DNA
taaaaatctctaccagtggc

SEQ ID NO: 26971 - DNA, 20 bp, synthetic construct
  source 1..20: mol_type = other DNA
taaaaatctctagaagtggc

SEQ ID NO: 26972 - DNA, 20 bp, synthetic construct
  source 1..20: mol_type = other DNA
aatcaaaagaaggttgccaa

SEQ ID NO: 26973 - DNA, 20 bp, synthetic construct
  source 1..20: mol_type = other DNA
aaagcaaagaaggatgtcaa

SEQ ID NO: 26974 - DNA, 20 bp, synthetic construct
  source 1..20: mol_type = other DNA
aaagtaggaccagaggagat

SEQ ID NO: 26975 - DNA, 20 bp, synthetic construct
  source 1..20: mol_type = other DNA
ctcagacctctttagtccgg

SEQ ID NO: 26976 - DNA, 20 bp, synthetic construct
  source 1..20: mol_type = other DNA
ctcagatattaagtgtctgt

SEQ ID NO: 26977 - DNA, 20 bp, synthetic construct
  source 1..20: mol_type = other DNA
ctcagaccatctggactgag

SEQ ID NO: 26978 - DNA, 20 bp, synthetic construct
  source 1..20: mol_type = other DNA
aaagcgaaagtagaaccaga

SEQ ID NO: 26979 - DNA, 20 bp, synthetic construct
  source 1..20: mol_type = other DNA
aaagcgaaagtgagaccaga

SEQ ID NO: 26980 - DNA, 20 bp, synthetic construct
  source 1..20: mol_type = other DNA
aaagtgaaagtaagaccaga

SEQ ID NO: 26981 - DNA, 20 bp, synthetic construct
  source 1..20: mol_type = other DNA
aaaagcgaaagtaaaaccag

SEQ ID NO: 26982 - DNA, 20 bp, synthetic construct
  source 1..20: mol_type = other DNA
aaagcgaaagtaagaccaga

SEQ ID NO: 26983 - DNA, 20 bp, synthetic construct
  source 1..20: mol_type = other DNA
aaaagcgaaaataaaaccag

SEQ ID NO: 26984 - DNA, 20 bp, synthetic construct
  source 1..20: mol_type = other DNA
gaaagtgaaagagaaaccag

SEQ ID NO: 26985 - DNA, 20 bp, synthetic construct
  source 1..20: mol_type = other DNA
aaaacgaaagtaaggccaga

SEQ ID NO: 26986 - DNA, 20 bp, synthetic construct
  source 1..20: mol_type = other DNA
aaaacgaaagtgtaaccgga

SEQ ID NO: 26987 - DNA, 20 bp, synthetic construct
  source 1..20: mol_type = other DNA
aaagcgaaagagaaaccaga

SEQ ID NO: 26988 - DNA, 20 bp, synthetic construct
  source 1..20: mol_type = other DNA
aaagcgaaagtaaaaccaga

SEQ ID NO: 26989 - DNA, 20 bp, synthetic construct
  source 1..20: mol_type = other DNA
aagcgaaagcgaaagccaga

SEQ ID NO: 26990 - DNA, 20 bp, synthetic construct
  source 1..20: mol_type = other DNA
agatcacttagactgaagca

SEQ ID NO: 26991 - DNA, 20 bp, synthetic construct
  source 1..20: mol_type = other DNA
ctcaaacccttttagtcagt

SEQ ID NO: 26992 - DNA, 20 bp, synthetic construct
  source 1..20: mol_type = other DNA
ctcagaccattctagtcagt

SEQ ID NO: 26993 - DNA, 20 bp, synthetic construct
  source 1..20: mol_type = other DNA
actgtctgcgtcatttggtg

SEQ ID NO: 26994 - DNA, 20 bp, synthetic construct
  source 1..20: mol_type = other DNA
agaaaacctccgacgcaacg

SEQ ID NO: 26995 - DNA, 20 bp, synthetic construct
  source 1..20: mol_type = other DNA
cgaaaacgaaagttccagag

SEQ ID NO: 26996 - DNA, 20 bp, synthetic construct
  source 1..20: mol_type = other DNA
cctcagaccatctagactga

SEQ ID NO: 26997 - DNA, 20 bp, synthetic construct
  source 1..20: mol_type = other DNA
cctcagacctctttggtcag

SEQ ID NO: 26998 - DNA, 20 bp, synthetic construct
  source 1..20: mol_type = other DNA
agcctttttaatactgtctg

SEQ ID NO: 26999 - DNA, 20 bp, synthetic construct
  source 1..20: mol_type = other DNA
gaaaacctccgacgcaacgg

SEQ ID NO: 27000 - DNA, 20 bp, synthetic construct
  source 1..20: mol_type = other DNA
tccctcagaccactctagac

SEQ ID NO: 27001 - DNA, 20 bp, synthetic construct
  source 1..20: mol_type = other DNA
ggactcgaaagcggaagttc

SEQ ID NO: 27002 - DNA, 20 bp, synthetic construct
  source 1..20: mol_type = other DNA
ggactcgaaagcgaaagttc

SEQ ID NO: 27003 - DNA, 20 bp, synthetic construct
  source 1..20: mol_type = other DNA
gactcgaaagcgaaagttcc

SEQ ID NO: 27004 - DNA, 20 bp, synthetic construct
  source 1..20: mol_type = other DNA
ccctcagaccctttagtcag

SEQ ID NO: 27005 - DNA, 20 bp, synthetic construct
  source 1..20: mol_type = other DNA
ccctcagaccactctagact

SEQ ID NO: 27006 - DNA, 20 bp, synthetic construct
  source 1..20: mol_type = other DNA
atgaattagaaaaagttagg

SEQ ID NO: 27007 - DNA, 20 bp, synthetic construct
  source 1..20: mol_type = other DNA
cctcagactactctagacag

SEQ ID NO: 27008 - DNA, 20 bp, synthetic construct
  source 1..20: mol_type = other DNA
cctcagaccaatttggtagt

SEQ ID NO: 27009 - DNA, 20 bp, synthetic construct
  source 1..20: mol_type = other DNA
cctcagacctctgtagtcag

SEQ ID NO: 27010 - DNA, 20 bp, synthetic construct
  source 1..20: mol_type = other DNA
cctcagacctttttggcagt

SEQ ID NO: 27011 - DNA, 20 bp, synthetic construct
  source 1..20: mol_type = other DNA
cctcagacctttttggtagt

SEQ ID NO: 27012 - DNA, 20 bp, synthetic construct
  source 1..20: mol_type = other DNA
ctcagacaattctagtcagt

SEQ ID NO: 27013 - DNA, 20 bp, synthetic construct
  source 1..20: mol_type = other DNA
cctcagaccattttggtagt

SEQ ID NO: 27014 - DNA, 20 bp, synthetic construct
  source 1..20: mol_type = other DNA
aaaaatctctagcagtggcg

SEQ ID NO: 27015 - DNA, 20 bp, synthetic construct
  source 1..20: mol_type = other DNA
cgaaagtagaaccagagacg

SEQ ID NO: 27016 - DNA, 20 bp, synthetic construct
  source 1..20: mol_type = other DNA
ccctcagattaaattatagt

SEQ ID NO: 27017 - DNA, 20 bp, synthetic construct
  source 1..20: mol_type = other DNA
cctcagaccttttagtcagt

SEQ ID NO: 27018 - DNA, 20 bp, synthetic construct
  source 1..20: mol_type = other DNA
agcgaaaggaaaaccagagg

SEQ ID NO: 27019 - DNA, 20 bp, synthetic construct
  source 1..20: mol_type = other DNA
agactgtgtaaaaatctcta

SEQ ID NO: 27020 - DNA, 20 bp, synthetic construct
  source 1..20: mol_type = other DNA
gtttgtgtaaaaatctctag

SEQ ID NO: 27021 - DNA, 20 bp, synthetic construct
  source 1..20: mol_type = other DNA
acttagtgaaaaatctctag

SEQ ID NO: 27022 - DNA, 20 bp, synthetic construct
  source 1..20: mol_type = other DNA
actgtgtaaaaaatctctag

SEQ ID NO: 27023 - DNA, 20 bp, synthetic construct
  source 1..20: mol_type = other DNA
atcacttagactgaagcaga

SEQ ID NO: 27024 - DNA, 20 bp, synthetic construct
  source 1..20: mol_type = other DNA
cagaccaccttagcagagtg

SEQ ID NO: 27025 - DNA, 20 bp, synthetic construct
  source 1..20: mol_type = other DNA
cagactctcgtagtcagtgt

SEQ ID NO: 27026 - DNA, 20 bp, synthetic construct
  source 1..20: mol_type = other DNA
ctcagaccaattgtggtagt

SEQ ID NO: 27027 - DNA, 20 bp, synthetic construct
  source 1..20: mol_type = other DNA
atgaattagaaaaaattagg

SEQ ID NO: 27028 - DNA, 20 bp, synthetic construct
  source 1..20: mol_type = other DNA
ctcgaaagcgaaagttacag

SEQ ID NO: 27029 - DNA, 20 bp, synthetic construct
  source 1..20: mol_type = other DNA
cgcgaaagcgaaagtagaac

SEQ ID NO: 27030 - DNA, 20 bp, synthetic construct
  source 1..20: mol_type = other DNA
cttgaaagcgaaagtagaac

SEQ ID NO: 27031 - DNA, 20 bp, synthetic construct
  source 1..20: mol_type = other DNA
gaagaaaacctccgacgcga

SEQ ID NO: 27032 - DNA, 20 bp, synthetic construct
  source 1..20: mol_type = other DNA
actcgaaagcggcggttcca

SEQ ID NO: 27033 - DNA, 20 bp, synthetic construct
  source 1..20: mol_type = other DNA
actcgaaagcggaagttcca

SEQ ID NO: 27034 - DNA, 20 bp, synthetic construct
  source 1..20: mol_type = other DNA
ctcgaaaacgaaagttccag

SEQ ID NO: 27035 - DNA, 20 bp, synthetic construct
  source 1..20: mol_type = other DNA
actcgaaagcgaaagttcca

SEQ ID NO: 27036 - DNA, 20 bp, synthetic construct
  source 1..20: mol_type = other DNA
atgaattagaaagaattagg

SEQ ID NO: 27037 - DNA, 20 bp, synthetic construct
  source 1..20: mol_type = other DNA
ctcagacccttgttggttgc

SEQ ID NO: 27038 - DNA, 20 bp, synthetic construct
  source 1..20: mol_type = other DNA
atgaattagaaaaggttagg

SEQ ID NO: 27039 - DNA, 20 bp, synthetic construct
  source 1..20: mol_type = other DNA
gggactcgaaagcgaaagtt

SEQ ID NO: 27040 - DNA, 20 bp, synthetic construct
  source 1..20: mol_type = other DNA
ggagcgtggcccctggacgc

SEQ ID NO: 27041 - DNA, 20 bp, synthetic construct
  source 1..20: mol_type = other DNA
atccctcagaccactataga

SEQ ID NO: 27042 - DNA, 20 bp, synthetic construct
  source 1..20: mol_type = other DNA
atccctcagaccactctaga

SEQ ID NO: 27043 - DNA, 20 bp, synthetic construct
  source 1..20: mol_type = other DNA
atccctcagaccactctagg

SEQ ID NO: 27044 - DNA, 20 bp, synthetic construct
  source 1..20: mol_type = other DNA
acttgaaagcgaaagtagaa

SEQ ID NO: 27045 - DNA, 20 bp, synthetic construct
  source 1..20: mol_type = other DNA
agtcaaaagaaggttgccaa

SEQ ID NO: 27046 - DNA, 20 bp, synthetic construct
  source 1..20: mol_type = other DNA
agaccaaagacggttgtcaa

SEQ ID NO: 27047 - DNA, 20 bp, synthetic construct
  source 1..20: mol_type = other DNA
agtcaaaagaagggtgtcaa

SEQ ID NO: 27048 - DNA, 20 bp, synthetic construct
  source 1..20: mol_type = other DNA
aaagtaaagaaggctgtcaa

SEQ ID NO: 27049 - DNA, 20 bp, synthetic construct
  source 1..20: mol_type = other DNA
actcgaaagcgaaagtgcca

SEQ ID NO: 27050 - DNA, 20 bp, synthetic construct
  source 1..20: mol_type = other DNA
gaatctctcgacgcacggac

SEQ ID NO: 27051 - DNA, 20 bp, synthetic construct
  source 1..20: mol_type = other DNA
agtgtaaaatctctagcagt

SEQ ID NO: 27052 - DNA, 20 bp, synthetic construct
  source 1..20: mol_type = other DNA
gactcgaaagcgaaagtgtt

SEQ ID NO: 27053 - DNA, 20 bp, synthetic construct
  source 1..20: mol_type = other DNA
gtgtaaaaatctctagcagt

SEQ ID NO: 27054 - DNA, 20 bp, synthetic construct
  source 1..20: mol_type = other DNA
tgtggaaaatctctagcagt

SEQ ID NO: 27055 - DNA, 20 bp, synthetic construct
  source 1..20: mol_type = other DNA
ctcagacccctttagtcagt

SEQ ID NO: 27056 - DNA, 20 bp, synthetic construct
  source 1..20: mol_type = other DNA
ctcagacccttttagccagt

SEQ ID NO: 27057 - DNA, 20 bp, synthetic construct
  source 1..20: mol_type = other DNA
ctcagaacattttagtccgg

SEQ ID NO: 27058 - DNA, 20 bp, synthetic construct
  source 1..20: mol_type = other DNA
ctcagaacctattagtcagt

SEQ ID NO: 27059 - DNA, 20 bp, synthetic construct
  source 1..20: mol_type = other DNA
ctcagacacattttgtccgt

SEQ ID NO: 27060 - DNA, 20 bp, synthetic construct
  source 1..20: mol_type = other DNA
ctcagacacttgtagtcagt

SEQ ID NO: 27061 - DNA, 20 bp, synthetic construct
  source 1..20: mol_type = other DNA
ctcagacatttgtagtcagt

SEQ ID NO: 27062 - DNA, 20 bp, synthetic construct
  source 1..20: mol_type = other DNA
ctcagaccaactttggtagt

SEQ ID NO: 27063 - DNA, 20 bp, synthetic construct
  source 1..20: mol_type = other DNA
ctcagaccaatttagtcagg

SEQ ID NO: 27064 - DNA, 20 bp, synthetic construct
  source 1..20: mol_type = other DNA
ctcagaccaatttagtccgt

SEQ ID NO: 27065 - DNA, 20 bp, synthetic construct
  source 1..20: mol_type = other DNA
ctcagaccatcttagtcagt

SEQ ID NO: 27066 - DNA, 20 bp, synthetic construct
  source 1..20: mol_type = other DNA
ctcagaccattcgtggtagt

SEQ ID NO: 27067 - DNA, 20 bp, synthetic construct
  source 1..20: mol_type = other DNA
ctcagaccatttagtcagtg

SEQ ID NO: 27068 - DNA, 20 bp, synthetic construct
  source 1..20: mol_type = other DNA
ctcagaccattttagtcagt

SEQ ID NO: 27069 - DNA, 20 bp, synthetic construct
  source 1..20: mol_type = other DNA
ctcagacccttaaagtcaat

SEQ ID NO: 27070 - DNA, 20 bp, synthetic construct
  source 1..20: mol_type = other DNA
ctcagacccttgtagtcagt

SEQ ID NO: 27071 - DNA, 20 bp, synthetic construct
  source 1..20: mol_type = other DNA
ctcagacccttttagtcagt

SEQ ID NO: 27072 - DNA, 20 bp, synthetic construct
  source 1..20: mol_type = other DNA
ctcagacccttttagtccgt

SEQ ID NO: 27073 - DNA, 20 bp, synthetic construct
  source 1..20: mol_type = other DNA
ctcagaccctttttggtagt

SEQ ID NO: 27074 - DNA, 20 bp, synthetic construct
  source 1..20: mol_type = other DNA
ctcagacctcggtagtcagt

SEQ ID NO: 27075 - DNA, 20 bp, synthetic construct
  source 1..20: mol_type = other DNA
ctcagacctctttagtcagt

SEQ ID NO: 27076 - DNA, 20 bp, synthetic construct
  source 1..20: mol_type = other DNA
ctcagactcttttagtcagt

SEQ ID NO: 27077 - DNA, 20 bp, synthetic construct
  source 1..20: mol_type = other DNA
ctcagaccatcctagttagt

SEQ ID NO: 27078 - DNA, 20 bp, synthetic construct
  source 1..20: mol_type = other DNA
ctcagatccttttagttagc

SEQ ID NO: 27079 - DNA, 20 bp, synthetic construct
  source 1..20: mol_type = other DNA
ctcatacccttttagtcagt

SEQ ID NO: 27080 - DNA, 20 bp, synthetic construct
  source 1..20: mol_type = other DNA
ctcagaccctattagtcagt

SEQ ID NO: 27081 - DNA, 20 bp, synthetic construct
  source 1..20: mol_type = other DNA
ctcagacccttgttggtagt

SEQ ID NO: 27082 - DNA, 20 bp, synthetic construct
  source 1..20: mol_type = other DNA
ctcagacccttgttggtatt

SEQ ID NO: 27083 - DNA, 20 bp, synthetic construct
  source 1..20: mol_type = other DNA
ctcagacaccttttgtcagt

SEQ ID NO: 27084 - DNA, 20 bp, synthetic construct
  source 1..20: mol_type = other DNA
ctcagaccctttgtggtagt

SEQ ID NO: 27085 - DNA, 20 bp, synthetic construct
  source 1..20: mol_type = other DNA
ggacgcgaaagcgaaagttc

SEQ ID NO: 27086 - DNA, 20 bp, synthetic construct
  source 1..20: mol_type = other DNA
gtagagatccctcagatctc

SEQ ID NO: 27087 - DNA, 20 bp, synthetic construct
  source 1..20: mol_type = other DNA
gtagagatccctcagatttg

SEQ ID NO: 27088 - DNA, 20 bp, synthetic construct
  source 1..20: mol_type = other DNA
agtaaaaatctctagcagtg

SEQ ID NO: 27089 - DNA, 20 bp, synthetic construct
  source 1..20: mol_type = other DNA
cgaacagggacttgaaaacg

SEQ ID NO: 27090 - DNA, 20 bp, synthetic construct
  source 1..20: mol_type = other DNA
gaaagtagaaccagaggaga

SEQ ID NO: 27091 - DNA, 20 bp, synthetic construct
  source 1..20: mol_type = other DNA
gaaagtagaaccagagaaga

SEQ ID NO: 27092 - DNA, 20 bp, synthetic construct
  source 1..20: mol_type = other DNA
ctcagaactcttaaaagtag

SEQ ID NO: 27093 - DNA, 20 bp, synthetic construct
  source 1..20: mol_type = other DNA
tcagaccacttgggctgagt

SEQ ID NO: 27094 - DNA, 20 bp, synthetic construct
  source 1..20: mol_type = other DNA
aaagtaaaaccagaggagat

SEQ ID NO: 27095 - DNA, 20 bp, synthetic construct
  source 1..20: mol_type = other DNA
aagcgaaagtaagaccagag

SEQ ID NO: 27096 - DNA, 20 bp, synthetic construct
  source 1..20: mol_type = other DNA
aagcgaaagtagaaccagag

SEQ ID NO: 27097 - DNA, 20 bp, synthetic construct
  source 1..20: mol_type = other DNA
aagcgaaagtaagaccggag

SEQ ID NO: 27098 - DNA, 20 bp, synthetic construct
  source 1..20: mol_type = other DNA
aagcgaaagtgagaccagag

SEQ ID NO: 27099 - DNA, 20 bp, synthetic construct
  source 1..20: mol_type = other DNA
aaacgaaagtaagaccagag

SEQ ID NO: 27100 - DNA, 20 bp, synthetic construct
  source 1..20: mol_type = other DNA
aagcgaaagtaaaaccagag

SEQ ID NO: 27101 - DNA, 20 bp, synthetic construct
  source 1..20: mol_type = other DNA
aagtgaaagtagaaccagag

SEQ ID NO: 27102 - DNA, 20 bp, synthetic construct
  source 1..20: mol_type = other DNA
gactgtgtaaaaatctctag

SEQ ID NO: 27103 - DNA, 20 bp, synthetic construct
  source 1..20: mol_type = other DNA
gattgagtaaaaatctctag

SEQ ID NO: 27104 - DNA, 20 bp, synthetic construct
  source 1..20: mol_type = other DNA
gacggtgtaaaaatctctag

SEQ ID NO: 27105 - DNA, 20 bp, synthetic construct
  source 1..20: mol_type = other DNA
gcttgagtagaaatctctag

SEQ ID NO: 27106 - DNA, 20 bp, synthetic construct
  source 1..20: mol_type = other DNA
gtcactgtagaaaatctcta

SEQ ID NO: 27107 - DNA, 20 bp, synthetic construct
  source 1..20: mol_type = other DNA
gtcagtgtaaaaatctctag

SEQ ID NO: 27108 - DNA, 20 bp, synthetic construct
  source 1..20: mol_type = other DNA
gatcacgtagactgaggcag

SEQ ID NO: 27109 - DNA, 20 bp, synthetic construct
  source 1..20: mol_type = other DNA
gatcacttagactgaagcag

SEQ ID NO: 27110 - DNA, 20 bp, synthetic construct
  source 1..20: mol_type = other DNA
gatcacatagactgaagcag

SEQ ID NO: 27111 - DNA, 20 bp, synthetic construct
  source 1..20: mol_type = other DNA
tcagaccattttagtcagag

SEQ ID NO: 27112 - DNA, 20 bp, synthetic construct
  source 1..20: mol_type = other DNA
tcagaccattttagtcagtg

SEQ ID NO: 27113 - DNA, 20 bp, synthetic construct
  source 1..20: mol_type = other DNA
tcagacccttttagtcagtg

SEQ ID NO: 27114 - DNA, 20 bp, synthetic construct
  source 1..20: mol_type = other DNA
tcagacagctttagtccggg

SEQ ID NO: 27115 - DNA, 20 bp, synthetic construct
  source 1..20: mol_type = other DNA
ccctcagatcacgtagactg

SEQ ID NO: 27116 - DNA, 20 bp, synthetic construct
  source 1..20: mol_type = other DNA
acgcggcccctggacgcagg

SEQ ID NO: 27117 - DNA, 20 bp, synthetic construct
  source 1..20: mol_type = other DNA
tgtgtggaaaatctctagca

SEQ ID NO: 27118 - DNA, 20 bp, synthetic construct
  source 1..20: mol_type = other DNA
agacccttttagtcagtgtg

SEQ ID NO: 27119 - DNA, 20 bp, synthetic construct
  source 1..20: mol_type = other DNA
tgtgtgactctggtaactag

SEQ ID NO: 27120 - DNA, 20 bp, synthetic construct
  source 1..20: mol_type = other DNA
agagcacttcccaacgctgc

SEQ ID NO: 27121 - DNA, 20 bp, synthetic construct
  source 1..20: mol_type = other DNA
gcctccctgcgcacccgcag

SEQ ID NO: 27122 - DNA, 20 bp, synthetic construct
  source 1..20: mol_type = other DNA
cagccttcgctccaggggaa

SEQ ID NO: 27123 - DNA, 20 bp, synthetic construct
  source 1..20: mol_type = other DNA
cagccttcgctctaggggaa

SEQ ID NO: 27124 - DNA, 20 bp, synthetic construct
  source 1..20: mol_type = other DNA
aagccttcatccttctgggt

SEQ ID NO: 27125 - DNA, 20 bp, synthetic construct
  source 1..20: mol_type = other DNA
gcacagagtcggcgctccct

SEQ ID NO: 27126 - DNA, 20 bp, synthetic construct
  source 1..20: mol_type = other DNA
acacattggactcgctgggc

SEQ ID NO: 27127 - DNA, 20 bp, synthetic construct
  source 1..20: mol_type = other DNA
acacgttggactggctgggc

SEQ ID NO: 27128 - DNA, 20 bp, synthetic construct
  source 1..20: mol_type = other DNA
acacgttggattcgctgggc

SEQ ID NO: 27129 - DNA, 20 bp, synthetic construct
  source 1..20: mol_type = other DNA
gaagacaccagtgggcccgt

SEQ ID NO: 27130 - DNA, 20 bp, synthetic construct
  source 1..20: mol_type = other DNA
ccgccaggcacttctttccg

SEQ ID NO: 27131 - DNA, 20 bp, synthetic construct
  source 1..20: mol_type = other DNA
acttttttcacatatcaact

SEQ ID NO: 27132 - DNA, 20 bp, synthetic construct
  source 1..20: mol_type = other DNA
ttggggtgtttcgcgagtgt

SEQ ID NO: 27133 - DNA, 20 bp, synthetic construct
  source 1..20: mol_type = other DNA
gaagatagtctccacttttt

SEQ ID NO: 27134 - DNA, 20 bp, synthetic construct
  source 1..20: mol_type = other DNA
tcttactggtgtgaggattt

SEQ ID NO: 27135 - DNA, 20 bp, synthetic construct
  source 1..20: mol_type = other DNA
ggcaggatgcgctaccgggc

SEQ ID NO: 27136 - DNA, 20 bp, synthetic construct
  source 1..20: mol_type = other DNA
aatcaggctcaggttctgag

SEQ ID NO: 27137 - DNA, 20 bp, synthetic construct
  source 1..20: mol_type = other DNA
gtttccttggttttaggtgc

SEQ ID NO: 27138 - DNA, 20 bp, synthetic construct
  source 1..20: mol_type = other DNA
taatacattctttttagccg

SEQ ID NO: 27139 - DNA, 20 bp, synthetic construct
  source 1..20: mol_type = other DNA
cccagcgctttggcttctct

SEQ ID NO: 27140 - DNA, 20 bp, synthetic construct
  source 1..20: mol_type = other DNA
tgcctcatgacctactcggc

SEQ ID NO: 27141 - DNA, 20 bp, synthetic construct
  source 1..20: mol_type = other DNA
cgttacggatcggcttactc

SEQ ID NO: 27142 - DNA, 20 bp, synthetic construct
  source 1..20: mol_type = other DNA
cgttacgaatcggcttactc

SEQ ID NO: 27143 - DNA, 20 bp, synthetic construct
  source 1..20: mol_type = other DNA
cgttacggatcggtttactc

SEQ ID NO: 27144 - DNA, 20 bp, synthetic construct
  source 1..20: mol_type = other DNA
agtcttcagcggcgctggct

SEQ ID NO: 27145 - DNA, 20 bp, synthetic construct
  source 1..20: mol_type = other DNA
aggaactggccggggtccgc

SEQ ID NO: 27146 - DNA, 20 bp, synthetic construct
  source 1..20: mol_type = other DNA
tcctcagcttctcatccctg

SEQ ID NO: 27147 - DNA, 20 bp, synthetic construct
  source 1..20: mol_type = other DNA
tcctcggcttctcatccctg

SEQ ID NO: 27148 - DNA, 20 bp, synthetic construct
  source 1..20: mol_type = other DNA
ggcagccgccgcttcccctt

SEQ ID NO: 27149 - DNA, 20 bp, synthetic construct
  source 1..20: mol_type = other DNA
gacctcgcgagccttccgca

SEQ ID NO: 27150 - DNA, 20 bp, synthetic construct
  source 1..20: mol_type = other DNA
cattgttttatacatagcac

SEQ ID NO: 27151 - DNA, 20 bp, synthetic construct
  source 1..20: mol_type = other DNA
ttcacggttcccacccagga

SEQ ID NO: 27152 - DNA, 20 bp, synthetic construct
  source 1..20: mol_type = other DNA
ttcacggttcccatccagga

SEQ ID NO: 27153 - DNA, 20 bp, synthetic construct
  source 1..20: mol_type = other DNA
ttcatggttcccacccagga

SEQ ID NO: 27154 - DNA, 20 bp, synthetic construct
  source 1..20: mol_type = other DNA
ctcccgcaacttgcggagct

SEQ ID NO: 27155 - DNA, 20 bp, synthetic construct
  source 1..20: mol_type = other DNA
ccagtagaatggccaggaca

SEQ ID NO: 27156 - DNA, 20 bp, synthetic construct
  source 1..20: mol_type = other DNA
gggttcgcgcgccctccccc

SEQ ID NO: 27157 - DNA, 20 bp, synthetic construct
  source 1..20: mol_type = other DNA
cttggccctccaactccttt

SEQ ID NO: 27158 - DNA, 20 bp, synthetic construct
  source 1..20: mol_type = other DNA
cacaagcgacacaaatgaac

SEQ ID NO: 27159 - DNA, 20 bp, synthetic construct
  source 1..20: mol_type = other DNA
aagtctccgccggaccctcc

SEQ ID NO: 27160 - DNA, 20 bp, synthetic construct
  source 1..20: mol_type = other DNA
tgtgaattactgtctcacag

SEQ ID NO: 27161 - DNA, 20 bp, synthetic construct
  source 1..20: mol_type = other DNA
gcactggaacttacaacacc

SEQ ID NO: 27162 - DNA, 20 bp, synthetic construct
  source 1..20: mol_type = other DNA
gcaaggcgccacgcaaacag

SEQ ID NO: 27163 - DNA, 20 bp, synthetic construct
  source 1..20: mol_type = other DNA
gtctgtgtcttttggctccg

SEQ ID NO: 27164 - DNA, 20 bp, synthetic construct
  source 1..20: mol_type = other DNA
ccggagcccggggcgtccgc

SEQ ID NO: 27165 - DNA, 20 bp, synthetic construct
  source 1..20: mol_type = other DNA
atccctcatccttcatccct

SEQ ID NO: 27166 - DNA, 20 bp, synthetic construct
  source 1..20: mol_type = other DNA
agtatgttctgccacgttcc

SEQ ID NO: 27167 - DNA, 20 bp, synthetic construct
  source 1..20: mol_type = other DNA
ggcgtgctctcttccctgag

SEQ ID NO: 27168 - DNA, 20 bp, synthetic construct
  source 1..20: mol_type = other DNA
cctttgtgaaagcaaagatg

SEQ ID NO: 27169 - DNA, 20 bp, synthetic construct
  source 1..20: mol_type = other DNA
cctttttgaaagcaaagatg

SEQ ID NO: 27170 - DNA, 20 bp, synthetic construct
  source 1..20: mol_type = other DNA
cgtttttgaaagcaaagatg

SEQ ID NO: 27171 - DNA, 20 bp, synthetic construct
  source 1..20: mol_type = other DNA
gctttgtgaaagcaaagatg

SEQ ID NO: 27172 - DNA, 20 bp, synthetic construct
  source 1..20: mol_type = other DNA
gctttttgaaagcaaagatg

SEQ ID NO: 27173 - DNA, 20 bp, synthetic construct
  source 1..20: mol_type = other DNA
ggcgcgcgccccggggcggg

SEQ ID NO: 27174 - DNA, 20 bp, synthetic construct
  source 1..20: mol_type = other DNA
aacgcgcacgcgcttaagga

SEQ ID NO: 27175 - DNA, 20 bp, synthetic construct
  source 1..20: mol_type = other DNA
tccagcgatgccgccccagc

SEQ ID NO: 27176 - DNA, 20 bp, synthetic construct
  source 1..20: mol_type = other DNA
tgttgctgagttggtctctt

SEQ ID NO: 27177 - DNA, 20 bp, synthetic construct
  source 1..20: mol_type = other DNA
gaggttttggcagctctgga

SEQ ID NO: 27178 - DNA, 20 bp, synthetic construct
  source 1..20: mol_type = other DNA
cacagccccaaccgccgccg

SEQ ID NO: 27179 - DNA, 20 bp, synthetic construct
  source 1..20: mol_type = other DNA
aaagcgcgcgagcaagatgg

SEQ ID NO: 27180 - DNA, 20 bp, synthetic construct
  source 1..20: mol_type = other DNA
ggtccacggggaacccgaag

SEQ ID NO: 27181 - DNA, 20 bp, synthetic construct
  source 1..20: mol_type = other DNA
ggtccacggggaacctgaag

SEQ ID NO: 27182 - DNA, 20 bp, synthetic construct
  source 1..20: mol_type = other DNA
ctggagcctccagagggctg

SEQ ID NO: 27183 - DNA, 20 bp, synthetic construct
  source 1..20: mol_type = other DNA
tgagcacagaaccggaaact

SEQ ID NO: 27184 - DNA, 20 bp, synthetic construct
  source 1..20: mol_type = other DNA
ttaccgtggcgagttccgcg

SEQ ID NO: 27185 - DNA, 20 bp, synthetic construct
  source 1..20: mol_type = other DNA
tccccaggctcacgagcccc

SEQ ID NO: 27186 - DNA, 20 bp, synthetic construct
  source 1..20: mol_type = other DNA
caggggagcgagcccggccc

SEQ ID NO: 27187 - DNA, 20 bp, synthetic construct
  source 1..20: mol_type = other DNA
cgacgttgacttcgaaattg

SEQ ID NO: 27188 - DNA, 20 bp, synthetic construct
  source 1..20: mol_type = other DNA
tttttgaggctgcgcactcg

SEQ ID NO: 27189 - DNA, 20 bp, synthetic construct
  source 1..20: mol_type = other DNA
tctcttcctttctgggctcg

SEQ ID NO: 27190 - DNA, 20 bp, synthetic construct
  source 1..20: mol_type = other DNA
ttcttccgcttcctgtacca

SEQ ID NO: 27191 - DNA, 20 bp, synthetic construct
  source 1..20: mol_type = other DNA
ggctgaaggacttggggagc

SEQ ID NO: 27192 - DNA, 20 bp, synthetic construct
  source 1..20: mol_type = other DNA
cgggtcagagcccctttttt

SEQ ID NO: 27193 - DNA, 20 bp, synthetic construct
  source 1..20: mol_type = other DNA
accggccgccagcccatctg

SEQ ID NO: 27194 - DNA, 20 bp, synthetic construct
  source 1..20: mol_type = other DNA
accacccaggtagggggtta

SEQ ID NO: 27195 - DNA, 20 bp, synthetic construct
  source 1..20: mol_type = other DNA
atcacccaggtagggggtta

SEQ ID NO: 27196 - DNA, 20 bp, synthetic construct
  source 1..20: mol_type = other DNA
tattgtaaatattttatgaa

SEQ ID NO: 27197 - DNA, 20 bp, synthetic construct
  source 1..20: mol_type = other DNA
ggcagcatggcggcgggggc

SEQ ID NO: 27198 - DNA, 20 bp, synthetic construct
  source 1..20: mol_type = other DNA
ttgggggcctttccagaaaa

SEQ ID NO: 27199 - DNA, 20 bp, synthetic construct
  source 1..20: mol_type = other DNA
ttcccacatcggatcgcagg

SEQ ID NO: 27200 - DNA, 20 bp, synthetic construct
  source 1..20: mol_type = other DNA
cctgggaagtggccgcagag

SEQ ID NO: 27201 - DNA, 20 bp, synthetic construct
  source 1..20: mol_type = other DNA
ggctcaccatggaccgctgg

SEQ ID NO: 27202 - DNA, 20 bp, synthetic construct
  source 1..20: mol_type = other DNA
ccatcccggcagtcgtggct

SEQ ID NO: 27203 - DNA, 20 bp, synthetic construct
  source 1..20: mol_type = other DNA
tatgtatgtgtatgtatgtg

SEQ ID NO: 27204 - DNA, 20 bp, synthetic construct
  source 1..20: mol_type = other DNA
gaggcggggtttatagcccg

SEQ ID NO: 27205 - DNA, 20 bp, synthetic construct
  source 1..20: mol_type = other DNA
ccctgcccacccgcggaaac

SEQ ID NO: 27206 - DNA, 20 bp, synthetic construct
  source 1..20: mol_type = other DNA
ccaggactggtttctgtaag

SEQ ID NO: 27207 - DNA, 20 bp, synthetic construct
  source 1..20: mol_type = other DNA
gagatgctaagcgtcaccga

SEQ ID NO: 27208 - DNA, 20 bp, synthetic construct
  source 1..20: mol_type = other DNA
gaggtgccaagcgtcaccga

SEQ ID NO: 27209 - DNA, 20 bp, synthetic construct
  source 1..20: mol_type = other DNA
gaggtgctaagcgtcaccga

SEQ ID NO: 27210 - DNA, 20 bp, synthetic construct
  source 1..20: mol_type = other DNA
cctcgccgcaccacacacag

SEQ ID NO: 27211 - DNA, 20 bp, synthetic construct
  source 1..20: mol_type = other DNA
ttctttttctttttttccca

SEQ ID NO: 27212 - DNA, 20 bp, synthetic construct
  source 1..20: mol_type = other DNA
gtggggaggctattctgccc

SEQ ID NO: 27213 - DNA, 20 bp, synthetic construct
  source 1..20: mol_type = other DNA
gcgcttcattccttcttcca

SEQ ID NO: 27214 - DNA, 20 bp, synthetic construct
  source 1..20: mol_type = other DNA
cgccccgtgcaggctgtgga

SEQ ID NO: 27215 - DNA, 20 bp, synthetic construct
  source 1..20: mol_type = other DNA
gccacagccgcaacgccacc

SEQ ID NO: 27216 - DNA, 20 bp, synthetic construct
  source 1..20: mol_type = other DNA
gcgacagccgcaacgccacc

SEQ ID NO: 27217 - DNA, 20 bp, synthetic construct
  source 1..20: mol_type = other DNA
ctcccagcaaccggtctggc

SEQ ID NO: 27218 - DNA, 20 bp, synthetic construct
  source 1..20: mol_type = other DNA
ctgggcagctggacactggg

SEQ ID NO: 27219 - DNA, 20 bp, synthetic construct
  source 1..20: mol_type = other DNA
ctcttgagatctccggttgg

SEQ ID NO: 27220 - DNA, 20 bp, synthetic construct
  source 1..20: mol_type = other DNA
ctaatgcccaggaacatggc

SEQ ID NO: 27221 - DNA, 20 bp, synthetic construct
  source 1..20: mol_type = other DNA
gagatgattaaggccccgct

SEQ ID NO: 27222 - DNA, 20 bp, synthetic construct
  source 1..20: mol_type = other DNA
gtgggttgcaggaggtgctt

SEQ ID NO: 27223 - DNA, 20 bp, synthetic construct
  source 1..20: mol_type = other DNA
gtgggttgcaggtggtgctt

SEQ ID NO: 27224 - DNA, 20 bp, synthetic construct
  source 1..20: mol_type = other DNA
cgagtggcggctgcagcagc

SEQ ID NO: 27225 - DNA, 20 bp, synthetic construct
  source 1..20: mol_type = other DNA
aaccatgggctgctgtggct

SEQ ID NO: 27226 - DNA, 20 bp, synthetic construct
  source 1..20: mol_type = other DNA
ccggaggcgggagtcacagg

SEQ ID NO: 27227 - DNA, 20 bp, synthetic construct
  source 1..20: mol_type = other DNA
gcacaaggtgtcttttggta

SEQ ID NO: 27228 - DNA, 20 bp, synthetic construct
  source 1..20: mol_type = other DNA
gaaaagcggcccgacctgct

SEQ ID NO: 27229 - DNA, 20 bp, synthetic construct
  source 1..20: mol_type = other DNA
gcataccagatctcaccaga

SEQ ID NO: 27230 - DNA, 20 bp, synthetic construct
  source 1..20: mol_type = other DNA
cagcgaagtctactcccctc

SEQ ID NO: 27231 - DNA, 20 bp, synthetic construct
  source 1..20: mol_type = other DNA
ccatgcctgaaccggcaaaa

SEQ ID NO: 27232 - DNA, 20 bp, synthetic construct
  source 1..20: mol_type = other DNA
actagttttgttagatagtc

SEQ ID NO: 27233 - DNA, 20 bp, synthetic construct
  source 1..20: mol_type = other DNA
gctccagcgccagcgcagcc

SEQ ID NO: 27234 - DNA, 20 bp, synthetic construct
  source 1..20: mol_type = other DNA
ttaagccacaaaaaagccac

SEQ ID NO: 27235 - DNA, 20 bp, synthetic construct
  source 1..20: mol_type = other DNA
tgggatctggctacgccaga

SEQ ID NO: 27236 - DNA, 20 bp, synthetic construct
  source 1..20: mol_type = other DNA
gacgtcatcggggcgccgga

SEQ ID NO: 27237 - DNA, 20 bp, synthetic construct
  source 1..20: mol_type = other DNA
ggctaaagctgggagactga

SEQ ID NO: 27238 - DNA, 20 bp, synthetic construct
  source 1..20: mol_type = other DNA
cgggaccttcgcgacacacc

SEQ ID NO: 27239 - DNA, 20 bp, synthetic construct
  source 1..20: mol_type = other DNA
ccttgggaagaggatgatcc

SEQ ID NO: 27240 - DNA, 20 bp, synthetic construct
  source 1..20: mol_type = other DNA
caagtcctcggcagcctgat

SEQ ID NO: 27241 - DNA, 20 bp, synthetic construct
  source 1..20: mol_type = other DNA
gccccccaggctcccagacc

SEQ ID NO: 27242 - DNA, 20 bp, synthetic construct
  source 1..20: mol_type = other DNA
gactaccactgctttttcct

SEQ ID NO: 27243 - DNA, 20 bp, synthetic construct
  source 1..20: mol_type = other DNA
acttgagtgagatgagagag

SEQ ID NO: 27244 - DNA, 20 bp, synthetic construct
  source 1..20: mol_type = other DNA
ctccattctgggctcttgcc

SEQ ID NO: 27245 - DNA, 20 bp, synthetic construct
  source 1..20: mol_type = other DNA
gggacagcagagaagaaact

SEQ ID NO: 27246 - DNA, 20 bp, synthetic construct
  source 1..20: mol_type = other DNA
gatttgcaacatcctcaaag

SEQ ID NO: 27247 - DNA, 20 bp, synthetic construct
  source 1..20: mol_type = other DNA
tcctcctcccttgtcttaac

SEQ ID NO: 27248 - DNA, 20 bp, synthetic construct
  source 1..20: mol_type = other DNA
tctctggaagagaaaggaag

SEQ ID NO: 27249 - DNA, 20 bp, synthetic construct
  source 1..20: mol_type = other DNA
gtgtgttttgctctccagcc

SEQ ID NO: 27250 - DNA, 20 bp, synthetic construct
  source 1..20: mol_type = other DNA
aacccagaagtctcaagttt

SEQ ID NO: 27251 - DNA, 20 bp, synthetic construct
  source 1..20: mol_type = other DNA
ccattcaccggagcgcgcag

SEQ ID NO: 27252 - DNA, 20 bp, synthetic construct
  source 1..20: mol_type = other DNA
cgctgttgagaagctacccg

SEQ ID NO: 27253 - DNA, 20 bp, synthetic construct
  source 1..20: mol_type = other DNA
agaaaggaggagggcgctcc

SEQ ID NO: 27254 - DNA, 20 bp, synthetic construct
  source 1..20: mol_type = other DNA
gtgtgcccgctctccaagaa

SEQ ID NO: 27255 - DNA, 20 bp, synthetic construct
  source 1..20: mol_type = other DNA
ctgcttggatggtgtcttcc

SEQ ID NO: 27256 - DNA, 20 bp, synthetic construct
  source 1..20: mol_type = other DNA
attacgctctctacggcctg

SEQ ID NO: 27257 - DNA, 20 bp, synthetic construct
  source 1..20: mol_type = other DNA
acacgaagcttgcttctgcc

SEQ ID NO: 27258 - DNA, 20 bp, synthetic construct
  source 1..20: mol_type = other DNA
tgtggcgggatagttttcgg

SEQ ID NO: 27259 - DNA, 20 bp, synthetic construct
  source 1..20: mol_type = other DNA
agcgtgggctgacgcctcgc

SEQ ID NO: 27260 - DNA, 20 bp, synthetic construct
  source 1..20: mol_type = other DNA
tactcggagactgcgccgcg

SEQ ID NO: 27261 - DNA, 20 bp, synthetic construct
  source 1..20: mol_type = other DNA
tcttctcgcggatccagtgt

SEQ ID NO: 27262 - DNA, 20 bp, synthetic construct
  source 1..20: mol_type = other DNA
tgtgtgtccctctgagagtt

SEQ ID NO: 27263 - DNA, 20 bp, synthetic construct
  source 1..20: mol_type = other DNA
tagcgttcgtctggagtagc

SEQ ID NO: 27264 - DNA, 20 bp, synthetic construct
  source 1..20: mol_type = other DNA
gcagtactcgctgggctgag

SEQ ID NO: 27265 - DNA, 20 bp, synthetic construct
  source 1..20: mol_type = other DNA
tgtctcctccacctagcagt

SEQ ID NO: 27266 - DNA, 20 bp, synthetic construct
  source 1..20: mol_type = other DNA
gtcccttcttagctctcgcc

SEQ ID NO: 27267 - DNA, 20 bp, synthetic construct
  source 1..20: mol_type = other DNA
ctagctgctcgcacaggact

SEQ ID NO: 27268 - DNA, 20 bp, synthetic construct
  source 1..20: mol_type = other DNA
aggctgaaccacaaaaggcc

SEQ ID NO: 27269 - DNA, 20 bp, synthetic construct
  source 1..20: mol_type = other DNA
ggaaccaaggtgccagtgag

SEQ ID NO: 27270 - DNA, 20 bp, synthetic construct
  source 1..20: mol_type = other DNA
ccactccgccagaaggtcgc

SEQ ID NO: 27271 - DNA, 20 bp, synthetic construct
  source 1..20: mol_type = other DNA
aattcttctgtgggatcaga

SEQ ID NO: 27272 - DNA, 20 bp, synthetic construct
  source 1..20: mol_type = other DNA
ccagcgaccctaaagcttcc

SEQ ID NO: 27273 - DNA, 20 bp, synthetic construct
  source 1..20: mol_type = other DNA
tggcctaggctttgcctatt

SEQ ID NO: 27274 - DNA, 20 bp, synthetic construct
  source 1..20: mol_type = other DNA
atgaaagatgtacatgactt

SEQ ID NO: 27275 - DNA, 20 bp, synthetic construct
  source 1..20: mol_type = other DNA
cgacgcgtctttgtggtaac

SEQ ID NO: 27276 - DNA, 20 bp, synthetic construct
  source 1..20: mol_type = other DNA
attcctttggctcctccgaa

SEQ ID NO: 27277 - DNA, 20 bp, synthetic construct
  source 1..20: mol_type = other DNA
cagccattcctgaggaggac

SEQ ID NO: 27278 - DNA, 20 bp, synthetic construct
  source 1..20: mol_type = other DNA
taacccgctgaaagtttctc

SEQ ID NO: 27279 - DNA, 20 bp, synthetic construct
  source 1..20: mol_type = other DNA
tgctgctggtaacagggcct

SEQ ID NO: 27280 - DNA, 20 bp, synthetic construct
  source 1..20: mol_type = other DNA
tggaagcggatcgcgtggag

SEQ ID NO: 27281 - DNA, 20 bp, synthetic construct
  source 1..20: mol_type = other DNA
cccagatcttctcaactgga

SEQ ID NO: 27282 - DNA, 20 bp, synthetic construct
  source 1..20: mol_type = other DNA
gctggtaacagggccttgcc

SEQ ID NO: 27283 - DNA, 20 bp, synthetic construct
  source 1..20: mol_type = other DNA
ctgagacggccttggccgga

SEQ ID NO: 27284 - DNA, 20 bp, synthetic construct
  source 1..20: mol_type = other DNA
ggctcttctcggcgtgctgc

SEQ ID NO: 27285 - DNA, 20 bp, synthetic construct
  source 1..20: mol_type = other DNA
cccacgagccgaggcctcct

SEQ ID NO: 27286 - DNA, 20 bp, synthetic construct
  source 1..20: mol_type = other DNA
tgggctgctgcgcgccgcct

SEQ ID NO: 27287 - DNA, 20 bp, synthetic construct
  source 1..20: mol_type = other DNA
ccctgagccccagatctgac

SEQ ID NO: 27288 - DNA, 20 bp, synthetic construct
  source 1..20: mol_type = other DNA
ggcgcaacccacggctgctg

SEQ ID NO: 27289 - DNA, 20 bp, synthetic construct
  source 1..20: mol_type = other DNA
taggggcttcatctctctgc

SEQ ID NO: 27290 - DNA, 20 bp, synthetic construct
  source 1..20: mol_type = other DNA
accctagagaaatgagttgt

SEQ ID NO: 27291 - DNA, 20 bp, synthetic construct
  source 1..20: mol_type = other DNA
agttggaatgaatgatcaga

SEQ ID NO: 27292 - DNA, 20 bp, synthetic construct
  source 1..20: mol_type = other DNA
aggcggtagagcggagaaag

SEQ ID NO: 27293 - DNA, 20 bp, synthetic construct
  source 1..20: mol_type = other DNA
gttttaatagacctacggca

SEQ ID NO: 27294 - DNA, 20 bp, synthetic construct
  source 1..20: mol_type = other DNA
gctagcccgcagcgctcggc

SEQ ID NO: 27295 - DNA, 20 bp, synthetic construct
  source 1..20: mol_type = other DNA
ctcccgctgcgaagcagcgc

SEQ ID NO: 27296 - DNA, 20 bp, synthetic construct
  source 1..20: mol_type = other DNA
tcctgtgtgaaattgcttct

SEQ ID NO: 27297 - DNA, 20 bp, synthetic construct
  source 1..20: mol_type = other DNA
tgatgatttgtcattctagt

SEQ ID NO: 27298 - DNA, 20 bp, synthetic construct
  source 1..20: mol_type = other DNA
aagcgggtcctacgcacgct

SEQ ID NO: 27299 - DNA, 20 bp, synthetic construct
  source 1..20: mol_type = other DNA
cccacagatgctagaagctt

SEQ ID NO: 27300 - DNA, 20 bp, synthetic construct
  source 1..20: mol_type = other DNA
gcgttgttctggattcccgt

SEQ ID NO: 27301 - DNA, 20 bp, synthetic construct
  source 1..20: mol_type = other DNA
tcaccttgagccgggcgagc

SEQ ID NO: 27302 - DNA, 20 bp, synthetic construct
  source 1..20: mol_type = other DNA
ttggcgtcccatgactccac

SEQ ID NO: 27303 - DNA, 20 bp, synthetic construct
  source 1..20: mol_type = other DNA
cgcaacggatcgtttccgga

SEQ ID NO: 27304 - DNA, 20 bp, synthetic construct
  source 1..20: mol_type = other DNA
gcgaaatgttcttttggggc

SEQ ID NO: 27305 - DNA, 20 bp, synthetic construct
  source 1..20: mol_type = other DNA
gataccgagtccgcaacccc

SEQ ID NO: 27306 - DNA, 20 bp, synthetic construct
  source 1..20: mol_type = other DNA
actgtcaagacatttcttcg

SEQ ID NO: 27307 - DNA, 20 bp, synthetic construct
  source 1..20: mol_type = other DNA
ttgcatctcttcgcctctcg

SEQ ID NO: 27308 - DNA, 20 bp, synthetic construct
  source 1..20: mol_type = other DNA
ctaatgccagaatttgaaag

SEQ ID NO: 27309 - DNA, 20 bp, synthetic construct
  source 1..20: mol_type = other DNA
tcccgcgacaggaacatggc

SEQ ID NO: 27310 - DNA, 20 bp, synthetic construct
  source 1..20: mol_type = other DNA
ctctcagcgaaggccgaaaa

SEQ ID NO: 27311 - DNA, 20 bp, synthetic construct
  source 1..20: mol_type = other DNA
ttacagagaaggcagagatc

SEQ ID NO: 27312 - DNA, 20 bp, synthetic construct
  source 1..20: mol_type = other DNA
ttacagagggcatcacctag

SEQ ID NO: 27313 - DNA, 20 bp, synthetic construct
  source 1..20: mol_type = other DNA
acttgtgaaaggcagagatc

SEQ ID NO: 27314 - DNA, 20 bp, synthetic construct
  source 1..20: mol_type = other DNA
tgggacaagtgaaaatgtct

SEQ ID NO: 27315 - DNA, 20 bp, synthetic construct
  source 1..20: mol_type = other DNA
acctgcaggcattttgtgaa

SEQ ID NO: 27316 - DNA, 20 bp, synthetic construct
  source 1..20: mol_type = other DNA
tgtgcgggtttaataaaaaa

SEQ ID NO: 27317 - DNA, 20 bp, synthetic construct
  source 1..20: mol_type = other DNA
cccggcccaaccaagtttaa

SEQ ID NO: 27318 - DNA, 20 bp, synthetic construct
  source 1..20: mol_type = other DNA
aaacttaatgatctaagcgt

SEQ ID NO: 27319 - DNA, 20 bp, synthetic construct
  source 1..20: mol_type = other DNA
cattgttcccagccggatcc

SEQ ID NO: 27320 - DNA, 20 bp, synthetic construct
  source 1..20: mol_type = other DNA
gtaaaccgatcagatctagt

SEQ ID NO: 27321 - DNA, 20 bp, synthetic construct
  source 1..20: mol_type = other DNA
cgagcctcccaagatggcgg

SEQ ID NO: 27322 - DNA, 20 bp, synthetic construct
  source 1..20: mol_type = other DNA
ctgggtggtctaagtcctga

SEQ ID NO: 27323 - DNA, 20 bp, synthetic construct
  source 1..20: mol_type = other DNA
ctgggtggatctttaaaccc

SEQ ID NO: 27324 - DNA, 20 bp, synthetic construct
  source 1..20: mol_type = other DNA
gcataacttctaagtcctga

SEQ ID NO: 27325 - DNA, 20 bp, synthetic construct
  source 1..20: mol_type = other DNA
tagtggttcgcgcaacacgc

SEQ ID NO: 27326 - DNA, 20 bp, synthetic construct
  source 1..20: mol_type = other DNA
ggagccggctcccgggcgcg

SEQ ID NO: 27327 - DNA, 20 bp, synthetic construct
  source 1..20: mol_type = other DNA
tggaggttcttgtctcccct

SEQ ID NO: 27328 - DNA, 20 bp, synthetic construct
  source 1..20: mol_type = other DNA
accagtagcaaatgagatga

SEQ ID NO: 27329 - DNA, 20 bp, synthetic construct
  source 1..20: mol_type = other DNA
ttatctctccacgaatccag

SEQ ID NO: 27330 - DNA, 20 bp, synthetic construct
  source 1..20: mol_type = other DNA
cctcactaccacgaatccag

SEQ ID NO: 27331 - DNA, 20 bp, synthetic construct
  source 1..20: mol_type = other DNA
ctctcaccattgcaacagta

SEQ ID NO: 27332 - DNA, 20 bp, synthetic construct
  source 1..20: mol_type = other DNA
tttgtttttggcggaactac

SEQ ID NO: 27333 - DNA, 20 bp, synthetic construct
  source 1..20: mol_type = other DNA
aaatggggcaaataagaatt

SEQ ID NO: 27334 - DNA, 20 bp, synthetic construct
  source 1..20: mol_type = other DNA
ttgaacaccaaataagaatt

SEQ ID NO: 27335 - DNA, 20 bp, synthetic construct
  source 1..20: mol_type = other DNA
tgcagcagttcttggtattg

SEQ ID NO: 27336 - DNA, 20 bp, synthetic construct
  source 1..20: mol_type = other DNA
gagtaaaagggatttcaggc

SEQ ID NO: 27337 - DNA, 20 bp, synthetic construct
  source 1..20: mol_type = other DNA
gagtaaaatcatgcaagatg

SEQ ID NO: 27338 - DNA, 20 bp, synthetic construct
  source 1..20: mol_type = other DNA
cctcccactgtctcttgtat

SEQ ID NO: 27339 - DNA, 20 bp, synthetic construct
  source 1..20: mol_type = other DNA
agatatttccaatgcgacgg

SEQ ID NO: 27340 - DNA, 20 bp, synthetic construct
  source 1..20: mol_type = other DNA
agatatttgtgcctaatgca

SEQ ID NO: 27341 - DNA, 20 bp, synthetic construct
  source 1..20: mol_type = other DNA
tttatatcttctgtatatta

SEQ ID NO: 27342 - DNA, 20 bp, synthetic construct
  source 1..20: mol_type = other DNA
atgtgtgtgtatgtatatgt

SEQ ID NO: 27343 - DNA, 20 bp, synthetic construct
  source 1..20: mol_type = other DNA
tgaaagcgtttgtgttcatc

SEQ ID NO: 27344 - DNA, 20 bp, synthetic construct
  source 1..20: mol_type = other DNA
gcctctctttgaacctctcc

SEQ ID NO: 27345 - DNA, 20 bp, synthetic construct
  source 1..20: mol_type = other DNA
ttagtatcttgaacctctcc

SEQ ID NO: 27346 - DNA, 20 bp, synthetic construct
  source 1..20: mol_type = other DNA
tcccgggggggtcccgcctc

SEQ ID NO: 27347 - DNA, 20 bp, synthetic construct
  source 1..20: mol_type = other DNA
gtgttctccgagttcctgtc

SEQ ID NO: 27348 - DNA, 20 bp, synthetic construct
  source 1..20: mol_type = other DNA
aaaagggaagaaaaacaaaa

SEQ ID NO: 27349 - DNA, 20 bp, synthetic construct
  source 1..20: mol_type = other DNA
aaaagggactctttcagggt

SEQ ID NO: 27350 - DNA, 20 bp, synthetic construct
  source 1..20: mol_type = other DNA
tgtcttaacagtggatgcat

SEQ ID NO: 27351 - DNA, 20 bp, synthetic construct
  source 1..20: mol_type = other DNA
ctctcatccagtggatgcat

SEQ ID NO: 27352 - DNA, 20 bp, synthetic construct
  source 1..20: mol_type = other DNA
ctctcatcggacttgatatg

SEQ ID NO: 27353 - DNA, 20 bp, synthetic construct
  source 1..20: mol_type = other DNA
acggtcgggccctggaagga

SEQ ID NO: 27354 - DNA, 20 bp, synthetic construct
  source 1..20: mol_type = other DNA
aagcctcttttggcttctct

SEQ ID NO: 27355 - DNA, 20 bp, synthetic construct
  source 1..20: mol_type = other DNA
caggctgggctgcaggctct

SEQ ID NO: 27356 - DNA, 20 bp, synthetic construct
  source 1..20: mol_type = other DNA
ctgatgcgtgccctactctc

SEQ ID NO: 27357 - DNA, 20 bp, synthetic construct
  source 1..20: mol_type = other DNA
agttcactggtgcaatgagg

SEQ ID NO: 27358 - DNA, 20 bp, synthetic construct
  source 1..20: mol_type = other DNA
gtggggtaggtgcaatgagg

SEQ ID NO: 27359 - DNA, 20 bp, synthetic construct
  source 1..20: mol_type = other DNA
atgagacggacacaccttaa

SEQ ID NO: 27360 - DNA, 20 bp, synthetic construct
  source 1..20: mol_type = other DNA
catgccaagacacaccttaa

SEQ ID NO: 27361 - DNA, 20 bp, synthetic construct
  source 1..20: mol_type = other DNA
catgccaatggcataacact

SEQ ID NO: 27362 - DNA, 20 bp, synthetic construct
  source 1..20: mol_type = other DNA
aggaggctgcgaggagccgg

SEQ ID NO: 27363 - DNA, 20 bp, synthetic construct
  source 1..20: mol_type = other DNA
ggatctgcagctgggcaccg

SEQ ID NO: 27364 - DNA, 20 bp, synthetic construct
  source 1..20: mol_type = other DNA
ggatctgcagctgggctagc

SEQ ID NO: 27365 - DNA, 20 bp, synthetic construct
  source 1..20: mol_type = other DNA
atgctgatgaagataataat

SEQ ID NO: 27366 - DNA, 20 bp, synthetic construct
  source 1..20: mol_type = other DNA
cagcaccgctccttgggtcc

SEQ ID NO: 27367 - DNA, 20 bp, synthetic construct
  source 1..20: mol_type = other DNA
caggagagcgcggattggtc

SEQ ID NO: 27368 - DNA, 20 bp, synthetic construct
  source 1..20: mol_type = other DNA
cctctgctggtgaccagaag

SEQ ID NO: 27369 - DNA, 20 bp, synthetic construct
  source 1..20: mol_type = other DNA
gtctacggggtgaccagaag

SEQ ID NO: 27370 - DNA, 20 bp, synthetic construct
  source 1..20: mol_type = other DNA
tattctagtacacttaggat

SEQ ID NO: 27371 - DNA, 20 bp, synthetic construct
  source 1..20: mol_type = other DNA
cgcggctgcgcttcggtccc

SEQ ID NO: 27372 - DNA, 20 bp, synthetic construct
  source 1..20: mol_type = other DNA
gcgaaggccgaaaagaggct

SEQ ID NO: 27373 - DNA, 20 bp, synthetic construct
  source 1..20: mol_type = other DNA
gcgaaggcactgtgattctc

SEQ ID NO: 27374 - DNA, 20 bp, synthetic construct
  source 1..20: mol_type = other DNA
tagtgctatttttgtattta

SEQ ID NO: 27375 - DNA, 20 bp, synthetic construct
  source 1..20: mol_type = other DNA
ctcagaaacacagcaagcga

SEQ ID NO: 27376 - DNA, 20 bp, synthetic construct
  source 1..20: mol_type = other DNA
cgctggtaaacatccacacg

SEQ ID NO: 27377 - DNA, 20 bp, synthetic construct
  source 1..20: mol_type = other DNA
aacggaaaatcatcggccgt

SEQ ID NO: 27378 - DNA, 20 bp, synthetic construct
  source 1..20: mol_type = other DNA
acttttttccgtttcgtagt

SEQ ID NO: 27379 - DNA, 20 bp, synthetic construct
  source 1..20: mol_type = other DNA
ctcctggcgccagcgctagg

SEQ ID NO: 27380 - DNA, 20 bp, synthetic construct
  source 1..20: mol_type = other DNA
tttctccgggatccaagaga

SEQ ID NO: 27381 - DNA, 20 bp, synthetic construct
  source 1..20: mol_type = other DNA
aaaacttaggatccaagaga

SEQ ID NO: 27382 - DNA, 20 bp, synthetic construct
  source 1..20: mol_type = other DNA
agtgattggcctgtcgtaac

SEQ ID NO: 27383 - DNA, 20 bp, synthetic construct
  source 1..20: mol_type = other DNA
tagtccatgcctgtcgtaac

SEQ ID NO: 27384 - DNA, 20 bp, synthetic construct
  source 1..20: mol_type = other DNA
cactatctgctagacctaga

SEQ ID NO: 27385 - DNA, 20 bp, synthetic construct
  source 1..20: mol_type = other DNA
tgtggcctcattctgaacaa

SEQ ID NO: 27386 - DNA, 20 bp, synthetic construct
  source 1..20: mol_type = other DNA
tgtggccttccaggtggttg

SEQ ID NO: 27387 - DNA, 20 bp, synthetic construct
  source 1..20: mol_type = other DNA
aggcagggcggcgcaggatc

SEQ ID NO: 27388 - DNA, 20 bp, synthetic construct
  source 1..20: mol_type = other DNA
gaaagcgaaagggaaaccag

SEQ ID NO: 27389 - DNA, 20 bp, synthetic construct
  source 1..20: mol_type = other DNA
aggacatcagcgacagcgag

SEQ ID NO: 27390 - DNA, 20 bp, synthetic construct
  source 1..20: mol_type = other DNA
cgaattcttatacagtagat

SEQ ID NO: 27391 - DNA, 20 bp, synthetic construct
  source 1..20: mol_type = other DNA
aggttaataaattacaagta

SEQ ID NO: 27392 - DNA, 20 bp, synthetic construct
  source 1..20: mol_type = other DNA
aggttaatccggcgttgtct

SEQ ID NO: 27393 - DNA, 20 bp, synthetic construct
  source 1..20: mol_type = other DNA
aattactcagtttcaaaagg

SEQ ID NO: 27394 - DNA, 20 bp, synthetic construct
  source 1..20: mol_type = other DNA
ctgtctctgctgtgtggtgg

SEQ ID NO: 27395 - DNA, 20 bp, synthetic construct
  source 1..20: mol_type = other DNA
tcatttggccttaaatggga

SEQ ID NO: 27396 - DNA, 20 bp, synthetic construct
  source 1..20: mol_type = other DNA
cagggaccccttaaatggga

SEQ ID NO: 27397 - DNA, 20 bp, synthetic construct
  source 1..20: mol_type = other DNA
agccaaacactccattggga

SEQ ID NO: 27398 - DNA, 20 bp, synthetic construct
  source 1..20: mol_type = other DNA
gatcaaaagtaagaaaaact

SEQ ID NO: 27399 - DNA, 20 bp, synthetic construct
  source 1..20: mol_type = other DNA
ttagtttggtaagaaaaact

SEQ ID NO: 27400 - DNA, 20 bp, synthetic construct
  source 1..20: mol_type = other DNA
ctgctggtggggtagggatg

SEQ ID NO: 27401 - DNA, 20 bp, synthetic construct
  source 1..20: mol_type = other DNA
ttaggtgtcatacctaagat

SEQ ID NO: 27402 - DNA, 20 bp, synthetic construct
  source 1..20: mol_type = other DNA
gcgttgtccatacctaagat

SEQ ID NO: 27403 - DNA, 20 bp, synthetic construct
  source 1..20: mol_type = other DNA
tcctgggcctgcccatccaa

SEQ ID NO: 27404 - DNA, 20 bp, synthetic construct
  source 1..20: mol_type = other DNA
tcctgggctaatgggcgacg

SEQ ID NO: 27405 - DNA, 20 bp, synthetic construct
  source 1..20: mol_type = other DNA
actctgcagcggaaccgact

SEQ ID NO: 27406 - DNA, 20 bp, synthetic construct
  source 1..20: mol_type = other DNA
gttaccatatagctattgga

SEQ ID NO: 27407 - DNA, 20 bp, synthetic construct
  source 1..20: mol_type = other DNA
ctacaccttggtctttccgg

SEQ ID NO: 27408 - DNA, 20 bp, synthetic construct
  source 1..20: mol_type = other DNA
acctccatagaggagcagca

SEQ ID NO: 27409 - DNA, 20 bp, synthetic construct
  source 1..20: mol_type = other DNA
ggtcagggcttgggcgctag

SEQ ID NO: 27410 - DNA, 20 bp, synthetic construct
  source 1..20: mol_type = other DNA
tcacctctttacaaaaccac

SEQ ID NO: 27411 - DNA, 20 bp, synthetic construct
  source 1..20: mol_type = other DNA
agtatagtgccggccgccca

SEQ ID NO: 27412 - DNA, 20 bp, synthetic construct
  source 1..20: mol_type = other DNA
ccaccccggccggccgccca

SEQ ID NO: 27413 - DNA, 20 bp, synthetic construct
  source 1..20: mol_type = other DNA
gaacagatgatgataaacct

SEQ ID NO: 27414 - DNA, 20 bp, synthetic construct
  source 1..20: mol_type = other DNA
ccgtctgggatgataaacct

SEQ ID NO: 27415 - DNA, 20 bp, synthetic construct
  source 1..20: mol_type = other DNA
aaatagaagatttatttggg

SEQ ID NO: 27416 - DNA, 20 bp, synthetic construct
  source 1..20: mol_type = other DNA
agactcaaaatgtatggccc

SEQ ID NO: 27417 - DNA, 20 bp, synthetic construct
  source 1..20: mol_type = other DNA
ttatcataaagcgagttgga

SEQ ID NO: 27418 - DNA, 20 bp, synthetic construct
  source 1..20: mol_type = other DNA
aggcagaagtatgcaaagca

SEQ ID NO: 27419 - DNA, 20 bp, synthetic construct
  source 1..20: mol_type = other DNA
tccacccggtatgcaaagca

SEQ ID NO: 27420 - DNA, 20 bp, synthetic construct
  source 1..20: mol_type = other DNA
tgctcactcagcacaggatc

SEQ ID NO: 27421 - DNA, 20 bp, synthetic construct
  source 1..20: mol_type = other DNA
tgctcactggtggggctcct

SEQ ID NO: 27422 - DNA, 20 bp, synthetic construct
  source 1..20: mol_type = other DNA
cgggtggaacgagagggaac

SEQ ID NO: 27423 - DNA, 20 bp, synthetic construct
  source 1..20: mol_type = other DNA
cgggtggacgagccccacta

SEQ ID NO: 27424 - DNA, 20 bp, synthetic construct
  source 1..20: mol_type = other DNA
taccgaacacgagagggaac

SEQ ID NO: 27425 - DNA, 20 bp, synthetic construct
  source 1..20: mol_type = other DNA
tagggactgttctcttcaca

SEQ ID NO: 27426 - DNA, 20 bp, synthetic construct
  source 1..20: mol_type = other DNA
accttcaggttctcttcaca

SEQ ID NO: 27427 - DNA, 20 bp, synthetic construct
  source 1..20: mol_type = other DNA
gaagcgccggcctcggggct

SEQ ID NO: 27428 - DNA, 20 bp, synthetic construct
  source 1..20: mol_type = other DNA
atgtgtgatccagatatgct

SEQ ID NO: 27429 - DNA, 20 bp, synthetic construct
  source 1..20: mol_type = other DNA
ccgccccttcagccccggct

SEQ ID NO: 27430 - DNA, 20 bp, synthetic construct
  source 1..20: mol_type = other DNA
ggaaagacaggtccttaggt

SEQ ID NO: 27431 - DNA, 20 bp, synthetic construct
  source 1..20: mol_type = other DNA
ggaaagaccatcgggctcaa

SEQ ID NO: 27432 - DNA, 20 bp, synthetic construct
  source 1..20: mol_type = other DNA
agccggggcggaaaggctgc

SEQ ID NO: 27433 - DNA, 20 bp, synthetic construct
  source 1..20: mol_type = other DNA
caagcctacggaaaggctgc

SEQ ID NO: 27434 - DNA, 20 bp, synthetic construct
  source 1..20: mol_type = other DNA
agcaactaatcgaatcaaca

SEQ ID NO: 27435 - DNA, 20 bp, synthetic construct
  source 1..20: mol_type = other DNA
acctactggaaataacataa

SEQ ID NO: 27436 - DNA, 20 bp, synthetic construct
  source 1..20: mol_type = other DNA
acacgcttccctggattggc

SEQ ID NO: 27437 - DNA, 20 bp, synthetic construct
  source 1..20: mol_type = other DNA
ttcggagaggcagcgcggtt

SEQ ID NO: 27438 - DNA, 20 bp, synthetic construct
  source 1..20: mol_type = other DNA
ggaaattggccgcccgagcg

SEQ ID NO: 27439 - DNA, 20 bp, synthetic construct
  source 1..20: mol_type = other DNA
gttgacaatcccagtggggg

SEQ ID NO: 27440 - DNA, 20 bp, synthetic construct
  source 1..20: mol_type = other DNA
tcttctagactaggtgcgag

SEQ ID NO: 27441 - DNA, 20 bp, synthetic construct
  source 1..20: mol_type = other DNA
tcttctagttcgtcccatgt

SEQ ID NO: 27442 - DNA, 20 bp, synthetic construct
  source 1..20: mol_type = other DNA
cttcttgtgttttgttgtct

SEQ ID NO: 27443 - DNA, 20 bp, synthetic construct
  source 1..20: mol_type = other DNA
atgccaattttctcgagaaa

SEQ ID NO: 27444 - DNA, 20 bp, synthetic construct
  source 1..20: mol_type = other DNA
agagcataaggaatctactt

SEQ ID NO: 27445 - DNA, 20 bp, synthetic construct
  source 1..20: mol_type = other DNA
acttgaccaggagactgaag

SEQ ID NO: 27446 - DNA, 20 bp, synthetic construct
  source 1..20: mol_type = other DNA
cggactgaaggagactgaag

SEQ ID NO: 27447 - DNA, 20 bp, synthetic construct
  source 1..20: mol_type = other DNA
attgggcgggctgccacggc

SEQ ID NO: 27448 - DNA, 20 bp, synthetic construct
  source 1..20: mol_type = other DNA
gagaatctagttattagaca

SEQ ID NO: 27449 - DNA, 20 bp, synthetic construct
  source 1..20: mol_type = other DNA
gagaatctcccatgatttgc

SEQ ID NO: 27450 - DNA, 20 bp, synthetic construct
  source 1..20: mol_type = other DNA
ctagccacagctaactgccc

SEQ ID NO: 27451 - DNA, 20 bp, synthetic construct
  source 1..20: mol_type = other DNA
gataaataagctaactgccc

SEQ ID NO: 27452 - DNA, 20 bp, synthetic construct
  source 1..20: mol_type = other DNA
ctcacagtaaaatagcacag

SEQ ID NO: 27453 - DNA, 20 bp, synthetic construct
  source 1..20: mol_type = other DNA
tgttgctattagaggttctt

SEQ ID NO: 27454 - DNA, 20 bp, synthetic construct
  source 1..20: mol_type = other DNA
cagaatgcttagaggttctt

SEQ ID NO: 27455 - DNA, 20 bp, synthetic construct
  source 1..20: mol_type = other DNA
gacattctttgaagtgaagc

SEQ ID NO: 27456 - DNA, 20 bp, synthetic construct
  source 1..20: mol_type = other DNA
cctgggagtctcggaggggg

SEQ ID NO: 27457 - DNA, 20 bp, synthetic construct
  source 1..20: mol_type = other DNA
cctgggagtctcggagggga

SEQ ID NO: 27458 - DNA, 20 bp, synthetic construct
  source 1..20: mol_type = other DNA
agaccatatctcggagggga

SEQ ID NO: 27459 - DNA, 20 bp, synthetic construct
  source 1..20: mol_type = other DNA
gcggcgccgccagagtctga

SEQ ID NO: 27460 - DNA, 20 bp, synthetic construct
  source 1..20: mol_type = other DNA
tcgaatcatgcacacctgtt

SEQ ID NO: 27461 - DNA, 20 bp, synthetic construct
  source 1..20: mol_type = other DNA
aattcatttgcacacctgtt

SEQ ID NO: 27462 - DNA, 20 bp, synthetic construct
  source 1..20: mol_type = other DNA
ttcgtcgatgttggagtgtc

SEQ ID NO: 27463 - DNA, 20 bp, synthetic construct
  source 1..20: mol_type = other DNA
ctctacctcaccgtccaggg

SEQ ID NO: 27464 - DNA, 20 bp, synthetic construct
  source 1..20: mol_type = other DNA
tctagagccaccgtccaggg

SEQ ID NO: 27465 - DNA, 20 bp, synthetic construct
  source 1..20: mol_type = other DNA
tcacccttgacttggggagc

SEQ ID NO: 27466 - DNA, 20 bp, synthetic construct
  source 1..20: mol_type = other DNA
tatccgcctacgtatttccg

SEQ ID NO: 27467 - DNA, 20 bp, synthetic construct
  source 1..20: mol_type = other DNA
gcgaaaattacgtatttccg

SEQ ID NO: 27468 - DNA, 20 bp, synthetic construct
  source 1..20: mol_type = other DNA
ccttcccattcaccctagtc

SEQ ID NO: 27469 - DNA, 20 bp, synthetic construct
  source 1..20: mol_type = other DNA
caccgacccggggccggggc

SEQ ID NO: 27470 - DNA, 20 bp, synthetic construct
  source 1..20: mol_type = other DNA
ggggagggacatatacttct

SEQ ID NO: 27471 - DNA, 20 bp, synthetic construct
  source 1..20: mol_type = other DNA
ggggagggcggggccggggc

SEQ ID NO: 27472 - DNA, 20 bp, synthetic construct
  source 1..20: mol_type = other DNA
actggaaccccgcggggttc

SEQ ID NO: 27473 - DNA, 20 bp, synthetic construct
  source 1..20: mol_type = other DNA
actggaacttacaacacccg

SEQ ID NO: 27474 - DNA, 20 bp, synthetic construct
  source 1..20: mol_type = other DNA
cagtgcggagctcctgagac

SEQ ID NO: 27475 - DNA, 20 bp, synthetic construct
  source 1..20: mol_type = other DNA
cagatgaggagactgtcctt

SEQ ID NO: 27476 - DNA, 20 bp, synthetic construct
  source 1..20: mol_type = other DNA
agcactgagtttagtaatag

SEQ ID NO: 27477 - DNA, 20 bp, synthetic construct
  source 1..20: mol_type = other DNA
aacggaaaccaggtggaacc

SEQ ID NO: 27478 - DNA, 20 bp, synthetic construct
  source 1..20: mol_type = other DNA
ggccttaaatgggattctgt

SEQ ID NO: 27479 - DNA, 20 bp, synthetic construct
  source 1..20: mol_type = other DNA
ggagcctgggaggctgggtg

SEQ ID NO: 27480 - DNA, 20 bp, synthetic construct
  source 1..20: mol_type = other DNA
ccctcccaatcgatatgggc

SEQ ID NO: 27481 - DNA, 20 bp, synthetic construct
  source 1..20: mol_type = other DNA
ccctcccagcactatgccct

SEQ ID NO: 27482 - DNA, 20 bp, synthetic construct
  source 1..20: mol_type = other DNA
agaggtaggcactatgccct

SEQ ID NO: 27483 - DNA, 20 bp, synthetic construct
  source 1..20: mol_type = other DNA
gccaggtgtcctggggactc

SEQ ID NO: 27484 - DNA, 20 bp, synthetic construct
  source 1..20: mol_type = other DNA
aaggcagctcctggggactc

SEQ ID NO: 27485 - DNA, 20 bp, synthetic construct
  source 1..20: mol_type = other DNA
atcctcctctaaacgcgtgt

SEQ ID NO: 27486 - DNA, 20 bp, synthetic construct
  source 1..20: mol_type = other DNA
gcggatgcctaaacgcgtgt

SEQ ID NO: 27487 - DNA, 20 bp, synthetic construct
  source 1..20: mol_type = other DNA
agaactactgagaaaaacca

SEQ ID NO: 27488 - DNA, 20 bp, synthetic construct
  source 1..20: mol_type = other DNA
gtcactggttaacttaggat

SEQ ID NO: 27489 - DNA, 20 bp, synthetic construct
  source 1..20: mol_type = other DNA
ggatctgctctccggcaaag

SEQ ID NO: 27490 - DNA, 20 bp, synthetic construct
  source 1..20: mol_type = other DNA
aacatatttctccggcaaag

SEQ ID NO: 27491 - DNA, 20 bp, synthetic construct
  source 1..20: mol_type = other DNA
tgtttgggctaagacctggt

SEQ ID NO: 27492 - DNA, 20 bp, synthetic construct
  source 1..20: mol_type = other DNA
tgtttgggtatcagggaaaa

SEQ ID NO: 27493 - DNA, 20 bp, synthetic construct
  source 1..20: mol_type = other DNA
caatatggccggagctggcc

SEQ ID NO: 27494 - DNA, 20 bp, synthetic construct
  source 1..20: mol_type = other DNA
aactatggggtccgtgcgga

SEQ ID NO: 27495 - DNA, 20 bp, synthetic construct
  source 1..20: mol_type = other DNA
gcaggcagggtccgtgcgga

SEQ ID NO: 27496 - DNA, 20 bp, synthetic construct
  source 1..20: mol_type = other DNA
gtcccaaggcttcccagagc

SEQ ID NO: 27497 - DNA, 20 bp, synthetic construct
  source 1..20: mol_type = other DNA
ttagctctgtattaataata

SEQ ID NO: 27498 - DNA, 20 bp, synthetic construct
  source 1..20: mol_type = other DNA
attttttaccgaaaggcctg

SEQ ID NO: 27499 - DNA, 20 bp, synthetic construct
  source 1..20: mol_type = other DNA
gatgcttccaggagaatcaa

SEQ ID NO: 27500 - DNA, 20 bp, synthetic construct
  source 1..20: mol_type = other DNA
ttggagaagaagcactatct

SEQ ID NO: 27501 - DNA, 20 bp, synthetic construct
  source 1..20: mol_type = other DNA
gccccggggacttctctctg

SEQ ID NO: 27502 - DNA, 20 bp, synthetic construct
  source 1..20: mol_type = other DNA
gcccggggcgcggggtcgcc

SEQ ID NO: 27503 - DNA, 20 bp, synthetic construct
  source 1..20: mol_type = other DNA
tcaacctcgaaccgactact

SEQ ID NO: 27504 - DNA, 20 bp, synthetic construct
  source 1..20: mol_type = other DNA
cgccgcgggagcggttcgag

SEQ ID NO: 27505 - DNA, 20 bp, synthetic construct
  source 1..20: mol_type = other DNA
cgccgcggtgtgaaagtcga

SEQ ID NO: 27506 - DNA, 20 bp, synthetic construct
  source 1..20: mol_type = other DNA
ataaatttgagcggttcgag

SEQ ID NO: 27507 - DNA, 20 bp, synthetic construct
  source 1..20: mol_type = other DNA
caaggaggtgtacagccctg

SEQ ID NO: 27508 - DNA, 20 bp, synthetic construct
  source 1..20: mol_type = other DNA
ttgtactactaactcattaa

SEQ ID NO: 27509 - DNA, 20 bp, synthetic construct
  source 1..20: mol_type = other DNA
tgtgcggcgaggccgcccac

SEQ ID NO: 27510 - DNA, 20 bp, synthetic construct
  source 1..20: mol_type = other DNA
tgtgcggctccaggtgggct

SEQ ID NO: 27511 - DNA, 20 bp, synthetic construct
  source 1..20: mol_type = other DNA
aacatcagacaaagggccgc

SEQ ID NO: 27512 - DNA, 20 bp, synthetic construct
  source 1..20: mol_type = other DNA
ggaggacactcgcctaggat

SEQ ID NO: 27513 - DNA, 20 bp, synthetic construct
  source 1..20: mol_type = other DNA
aagtgagtctggtctgtggg

SEQ ID NO: 27514 - DNA, 20 bp, synthetic construct
  source 1..20: mol_type = other DNA
aagtgagtgcttctgccatc

SEQ ID NO: 27515 - DNA, 20 bp, synthetic construct
  source 1..20: mol_type = other DNA
gcaatcacgcttctgccatc

SEQ ID NO: 27516 - DNA, 20 bp, synthetic construct
  source 1..20: mol_type = other DNA
atgataggccaagatggcgg

SEQ ID NO: 27517 - DNA, 20 bp, synthetic construct
  source 1..20: mol_type = other DNA
cgcaagtccgtggcggaacc

SEQ ID NO: 27518 - DNA, 20 bp, synthetic construct
  source 1..20: mol_type = other DNA
tcggacagcacatgttagtc

SEQ ID NO: 27519 - DNA, 20 bp, synthetic construct
  source 1..20: mol_type = other DNA
aagaaggtccgggggctgga

SEQ ID NO: 27520 - DNA, 20 bp, synthetic construct
  source 1..20: mol_type = other DNA
cttgtgtgtagatctttggt

SEQ ID NO: 27521 - DNA, 20 bp, synthetic construct
  source 1..20: mol_type = other DNA
cttgtgtgcgatgggagatg

SEQ ID NO: 27522 - DNA, 20 bp, synthetic construct
  source 1..20: mol_type = other DNA
gcccgcaatagatctttggt

SEQ ID NO: 27523 - DNA, 20 bp, synthetic construct
  source 1..20: mol_type = other DNA
ccgctcaagatacttgttca

SEQ ID NO: 27524 - DNA, 20 bp, synthetic construct
  source 1..20: mol_type = other DNA
ccgctcaatgcctggagatt

SEQ ID NO: 27525 - DNA, 20 bp, synthetic construct
  source 1..20: mol_type = other DNA
agggagctaagctcaacgta

SEQ ID NO: 27526 - DNA, 20 bp, synthetic construct
  source 1..20: mol_type = other DNA
gttggcggtagttccaaccc

SEQ ID NO: 27527 - DNA, 20 bp, synthetic construct
  source 1..20: mol_type = other DNA
ccctaaaacagcaacgacac

SEQ ID NO: 27528 - DNA, 20 bp, synthetic construct
  source 1..20: mol_type = other DNA
aaccagtaagggaaccgccg

SEQ ID NO: 27529 - DNA, 20 bp, synthetic construct
  source 1..20: mol_type = other DNA
cgaacggcttgttggaatca

SEQ ID NO: 27530 - DNA, 20 bp, synthetic construct
  source 1..20: mol_type = other DNA
tagtgctattgttggaatca

SEQ ID NO: 27531 - DNA, 20 bp, synthetic construct
  source 1..20: mol_type = other DNA
ttcctccggactcctgcacg

SEQ ID NO: 27532 - DNA, 20 bp, synthetic construct
  source 1..20: mol_type = other DNA
aggacacccccgcccccccg

SEQ ID NO: 27533 - DNA, 20 bp, synthetic construct
  source 1..20: mol_type = other DNA
aggacaccgttaaaaaagac

SEQ ID NO: 27534 - DNA, 20 bp, synthetic construct
  source 1..20: mol_type = other DNA
catttttgcccgcccccccg

SEQ ID NO: 27535 - DNA, 20 bp, synthetic construct
  source 1..20: mol_type = other DNA
tgctgtagggccactgtctg

SEQ ID NO: 27536 - DNA, 20 bp, synthetic construct
  source 1..20: mol_type = other DNA
ctgcaggaggccactgtctg

SEQ ID NO: 27537 - DNA, 20 bp, synthetic construct
  source 1..20: mol_type = other DNA
gcgactgtgtccacggatgg

SEQ ID NO: 27538 - DNA, 20 bp, synthetic construct
  source 1..20: mol_type = other DNA
gtatttttaaaacttaggaa

SEQ ID NO: 27539 - DNA, 20 bp, synthetic construct
  source 1..20: mol_type = other DNA
acagccttcgctccagggga

SEQ ID NO: 27540 - DNA, 20 bp, synthetic construct
  source 1..20: mol_type = other DNA
acagccttgataatcactcg

SEQ ID NO: 27541 - DNA, 20 bp, synthetic construct
  source 1..20: mol_type = other DNA
ccgggtaggggagcgcagcg

SEQ ID NO: 27542 - DNA, 20 bp, synthetic construct
  source 1..20: mol_type = other DNA
gcgtcggatgttcagagcag

SEQ ID NO: 27543 - DNA, 20 bp, synthetic construct
  source 1..20: mol_type = other DNA
caactaattgttcagagcag

SEQ ID NO: 27544 - DNA, 20 bp, synthetic construct
  source 1..20: mol_type = other DNA
cggccgtccctgcggtcccg

SEQ ID NO: 27545 - DNA, 20 bp, synthetic construct
  source 1..20: mol_type = other DNA
ccaccaaggcggcgcagcgc

SEQ ID NO: 27546 - DNA, 20 bp, synthetic construct
  source 1..20: mol_type = other DNA
gagtagctaacgacctgatg

SEQ ID NO: 27547 - DNA, 20 bp, synthetic construct
  source 1..20: mol_type = other DNA
gagtagctgggattacaggc

SEQ ID NO: 27548 - DNA, 20 bp, synthetic construct
  source 1..20: mol_type = other DNA
cccaaagcacatcttaacct

SEQ ID NO: 27549 - DNA, 20 bp, synthetic construct
  source 1..20: mol_type = other DNA
gtatcgtgacatcttaacct

SEQ ID NO: 27550 - DNA, 20 bp, synthetic construct
  source 1..20: mol_type = other DNA
cccaaagccatagaggtagc

SEQ ID NO: 27551 - DNA, 20 bp, synthetic construct
  source 1..20: mol_type = other DNA
cccaaagcttcatggctgta

SEQ ID NO: 27552 - DNA, 20 bp, synthetic construct
  source 1..20: mol_type = other DNA
tactgctacatttttaagac

SEQ ID NO: 27553 - DNA, 20 bp, synthetic construct
  source 1..20: mol_type = other DNA
aagaagcgctaagagaggcc

SEQ ID NO: 27554 - DNA, 20 bp, synthetic construct
  source 1..20: mol_type = other DNA
tgctggggtcatgatggctc

SEQ ID NO: 27555 - DNA, 20 bp, synthetic construct
  source 1..20: mol_type = other DNA
ggctgaagtgtactacgctg

SEQ ID NO: 27556 - DNA, 20 bp, synthetic construct
  source 1..20: mol_type = other DNA
tatgcggcgccgactgtgat

SEQ ID NO: 27557 - DNA, 20 bp, synthetic construct
  source 1..20: mol_type = other DNA
tcctcggcccgcatattgac

SEQ ID NO: 27558 - DNA, 20 bp, synthetic construct
  source 1..20: mol_type = other DNA
tctcctccgggtgatgcttt

SEQ ID NO: 27559 - DNA, 20 bp, synthetic construct
  source 1..20: mol_type = other DNA
tctcctcctaaacgccggaa

SEQ ID NO: 27560 - DNA, 20 bp, synthetic construct
  source 1..20: mol_type = other DNA
cattcgccgagtttctaaac

SEQ ID NO: 27561 - DNA, 20 bp, synthetic construct
  source 1..20: mol_type = other DNA
ggctcagcgagagtgttctt

SEQ ID NO: 27562 - DNA, 20 bp, synthetic construct
  source 1..20: mol_type = other DNA
gagaactaggctgcagcagc

SEQ ID NO: 27563 - DNA, 20 bp, synthetic construct
  source 1..20: mol_type = other DNA
ctgctgctatagctggattt

SEQ ID NO: 27564 - DNA, 20 bp, synthetic construct
  source 1..20: mol_type = other DNA
gtggctaattgataggcagg

SEQ ID NO: 27565 - DNA, 20 bp, synthetic construct
  source 1..20: mol_type = other DNA
tcctgtaggaggagaaaacc

SEQ ID NO: 27566 - DNA, 20 bp, synthetic construct
  source 1..20: mol_type = other DNA
cttccctgtgctgtgagtgt

SEQ ID NO: 27567 - DNA, 20 bp, synthetic construct
  source 1..20: mol_type = other DNA
cttccctgccacagataaag

SEQ ID NO: 27568 - DNA, 20 bp, synthetic construct
  source 1..20: mol_type = other DNA
aacaggacgcgcgtgagctc

SEQ ID NO: 27569 - DNA, 20 bp, synthetic construct
  source 1..20: mol_type = other DNA
tccagcacaccaggcaaagc

SEQ ID NO: 27570 - DNA, 20 bp, synthetic construct
  source 1..20: mol_type = other DNA
tccagcacctgcaaatccag

SEQ ID NO: 27571 - DNA, 20 bp, synthetic construct
  source 1..20: mol_type = other DNA
gattgtaaaaaatttctaga

SEQ ID NO: 27572 - DNA, 20 bp, synthetic construct
  source 1..20: mol_type = other DNA
gattgtaagggccaagcttg

SEQ ID NO: 27573 - DNA, 20 bp, synthetic construct
  source 1..20: mol_type = other DNA
cgcctgcggggccaagcttg

SEQ ID NO: 27574 - DNA, 20 bp, synthetic construct
  source 1..20: mol_type = other DNA
aacagctggtttactggtca

SEQ ID NO: 27575 - DNA, 20 bp, synthetic construct
  source 1..20: mol_type = other DNA
aacagctgtagcgaccacac

SEQ ID NO: 27576 - DNA, 20 bp, synthetic construct
  source 1..20: mol_type = other DNA
ctacatgagagtcctccggc

SEQ ID NO: 27577 - DNA, 20 bp, synthetic construct
  source 1..20: mol_type = other DNA
ggctccccgagtcctccggc

SEQ ID NO: 27578 - DNA, 20 bp, synthetic construct
  source 1..20: mol_type = other DNA
cgtaatattcttgatcgggc

SEQ ID NO: 27579 - DNA, 20 bp, synthetic construct
  source 1..20: mol_type = other DNA
atacagcacgtaacaactgt

SEQ ID NO: 27580 - DNA, 20 bp, synthetic construct
  source 1..20: mol_type = other DNA
gctagttgcgtaacaactgt

SEQ ID NO: 27581 - DNA, 20 bp, synthetic construct
  source 1..20: mol_type = other DNA
agcaacaatctgagacacat

SEQ ID NO: 27582 - DNA, 20 bp, synthetic construct
  source 1..20: mol_type = other DNA
ggggtctgggggtgacattg

SEQ ID NO: 27583 - DNA, 20 bp, synthetic construct
  source 1..20: mol_type = other DNA
aaagtactactgaacaaagt

SEQ ID NO: 27584 - DNA, 20 bp, synthetic construct
  source 1..20: mol_type = other DNA
ctggtagtcctccggcccct

SEQ ID NO: 27585 - DNA, 20 bp, synthetic construct
  source 1..20: mol_type = other DNA
tagtgctatcttaataatta

SEQ ID NO: 27586 - DNA, 20 bp, synthetic construct
  source 1..20: mol_type = other DNA
taagactggaggaggaggag

SEQ ID NO: 27587 - DNA, 20 bp, synthetic construct
  source 1..20: mol_type = other DNA
ttgagaataggtaagtttct

SEQ ID NO: 27588 - DNA, 20 bp, synthetic construct
  source 1..20: mol_type = other DNA
gctgaagaaggctctgtgca

SEQ ID NO: 27589 - DNA, 20 bp, synthetic construct
  source 1..20: mol_type = other DNA
cagccaggaatataagctat

SEQ ID NO: 27590 - DNA, 20 bp, synthetic construct
  source 1..20: mol_type = other DNA
aagaactgtcgcgcaacttc

SEQ ID NO: 27591 - DNA, 20 bp, synthetic construct
  source 1..20: mol_type = other DNA
gtttttatattcgaagtagg

SEQ ID NO: 27592 - DNA, 20 bp, synthetic construct
  source 1..20: mol_type = other DNA
ctgcgcccaggtcctcccct

SEQ ID NO: 27593 - DNA, 20 bp, synthetic construct
  source 1..20: mol_type = other DNA
taataaatttaagagcagac

SEQ ID NO: 27594 - DNA, 20 bp, synthetic construct
  source 1..20: mol_type = other DNA
ctttctttcgattatcatca

SEQ ID NO: 27595 - DNA, 20 bp, synthetic construct
  source 1..20: mol_type = other DNA
tacaacagcgattatcatca

SEQ ID NO: 27596 - DNA, 20 bp, synthetic construct
  source 1..20: mol_type = other DNA
acgcggtctttctctagacg

SEQ ID NO: 27597 - DNA, 20 bp, synthetic construct
  source 1..20: mol_type = other DNA
gccagacctttgtaacaccc

SEQ ID NO: 27598 - DNA, 20 bp, synthetic construct
  source 1..20: mol_type = other DNA
aaagcgaattcatggggtct

SEQ ID NO: 27599 - DNA, 20 bp, synthetic construct
  source 1..20: mol_type = other DNA
gcgccgcggctcagggagga

SEQ ID NO: 27600 - DNA, 20 bp, synthetic construct
  source 1..20: mol_type = other DNA
actagtcactatacaataat

SEQ ID NO: 27601 - DNA, 20 bp, synthetic construct
  source 1..20: mol_type = other DNA
ctcttggaacaagataagac

SEQ ID NO: 27602 - DNA, 20 bp, synthetic construct
  source 1..20: mol_type = other DNA
actggtcccaggaccggcag

SEQ ID NO: 27603 - DNA, 20 bp, synthetic construct
  source 1..20: mol_type = other DNA
cttcgagatagccgccagga

SEQ ID NO: 27604 - DNA, 20 bp, synthetic construct
  source 1..20: mol_type = other DNA
gccaccttcctaatgtgttc

SEQ ID NO: 27605 - DNA, 20 bp, synthetic construct
  source 1..20: mol_type = other DNA
cagcgattccagaacaacat

SEQ ID NO: 27606 - DNA, 20 bp, synthetic construct
  source 1..20: mol_type = other DNA
acttggatttgatcttaatc

SEQ ID NO: 27607 - DNA, 20 bp, synthetic construct
  source 1..20: mol_type = other DNA
ttcacggtcgaacgagtatc

SEQ ID NO: 27608 - DNA, 20 bp, synthetic construct
  source 1..20: mol_type = other DNA
ttagcgcctaactgagcgtc

SEQ ID NO: 27609 - DNA, 20 bp, synthetic construct
  source 1..20: mol_type = other DNA
gaataacaactatgaacagg

SEQ ID NO: 27610 - DNA, 20 bp, synthetic construct
  source 1..20: mol_type = other DNA
gaataacagtctcttgacta

SEQ ID NO: 27611 - DNA, 20 bp, synthetic construct
  source 1..20: mol_type = other DNA
ccccgggtcaattcttggtt

SEQ ID NO: 27612 - DNA, 20 bp, synthetic construct
  source 1..20: mol_type = other DNA
tatgaaaacaattcttggtt

SEQ ID NO: 27613 - DNA, 20 bp, synthetic construct
  source 1..20: mol_type = other DNA
tctgggatataagaggcagc

SEQ ID NO: 27614 - DNA, 20 bp, synthetic construct
  source 1..20: mol_type = other DNA
gatggcggacgaagaggccg

SEQ ID NO: 27615 - DNA, 20 bp, synthetic construct
  source 1..20: mol_type = other DNA
gggcctcgctcaccggcggt

SEQ ID NO: 27616 - DNA, 20 bp, synthetic construct
  source 1..20: mol_type = other DNA
acgacgccgactaacgcccc

SEQ ID NO: 27617 - DNA, 20 bp, synthetic construct
  source 1..20: mol_type = other DNA
ttgttcgtcacttgtcgaca

SEQ ID NO: 27618 - DNA, 20 bp, synthetic construct
  source 1..20: mol_type = other DNA
gcgccctctcaccgcccggc

SEQ ID NO: 27619 - DNA, 20 bp, synthetic construct
  source 1..20: mol_type = other DNA
tgcgtgtttgtgattaacta

SEQ ID NO: 27620 - DNA, 20 bp, synthetic construct
  source 1..20: mol_type = other DNA
ttgctcgcgccccaaaaaca

SEQ ID NO: 27621 - DNA, 20 bp, synthetic construct
  source 1..20: mol_type = other DNA
atgttggatggcagccttga

SEQ ID NO: 27622 - DNA, 20 bp, synthetic construct
  source 1..20: mol_type = other DNA
gctgctccattgcaatgctc

SEQ ID NO: 27623 - DNA, 20 bp, synthetic construct
  source 1..20: mol_type = other DNA
gctgctcctggcagccttga

SEQ ID NO: 27624 - DNA, 20 bp, synthetic construct
  source 1..20: mol_type = other DNA
tctgtgacttcgggtccgta

SEQ ID NO: 27625 - DNA, 20 bp, synthetic construct
  source 1..20: mol_type = other DNA
ggcgcgctggagcgttttcc

SEQ ID NO: 27626 - DNA, 20 bp, synthetic construct
  source 1..20: mol_type = other DNA
cgtaacccaatgtgtatcta

SEQ ID NO: 27627 - DNA, 20 bp, synthetic construct
  source 1..20: mol_type = other DNA
gacacatgtctccgcccctg

SEQ ID NO: 27628 - DNA, 20 bp, synthetic construct
  source 1..20: mol_type = other DNA
cagcaccgaatgtcaagatt

SEQ ID NO: 27629 - DNA, 20 bp, synthetic construct
  source 1..20: mol_type = other DNA
attttgactggaatttcgga

SEQ ID NO: 27630 - DNA, 20 bp, synthetic construct
  source 1..20: mol_type = other DNA
ccggggcgaagggtatgtgg

SEQ ID NO: 27631 - DNA, 20 bp, synthetic construct
  source 1..20: mol_type = other DNA
ctttgtttcacttgccatat

SEQ ID NO: 27632 - DNA, 20 bp, synthetic construct
  source 1..20: mol_type = other DNA
attattaaacatccaatttg

SEQ ID NO: 27633 - DNA, 20 bp, synthetic construct
  source 1..20: mol_type = other DNA
ttgctcgctcagcacaggat

SEQ ID NO: 27634 - DNA, 20 bp, synthetic construct
  source 1..20: mol_type = other DNA
ccgctgcaggcccgcgcccg

SEQ ID NO: 27635 - DNA, 20 bp, synthetic construct
  source 1..20: mol_type = other DNA
tcaacaccgacttaggttca

SEQ ID NO: 27636 - DNA, 20 bp, synthetic construct
  source 1..20: mol_type = other DNA
agtgtcctatttaaaatggg

SEQ ID NO: 27637 - DNA, 20 bp, synthetic construct
  source 1..20: mol_type = other DNA
catacccaataaaagattat

SEQ ID NO: 27638 - DNA, 20 bp, synthetic construct
  source 1..20: mol_type = other DNA
catacccatccgtctcaggg

SEQ ID NO: 27639 - DNA, 20 bp, synthetic construct
  source 1..20: mol_type = other DNA
gagcatcttcattataatca

SEQ ID NO: 27640 - DNA, 20 bp, synthetic construct
  source 1..20: mol_type = other DNA
ccgcagaaggttgtcctgta

SEQ ID NO: 27641 - DNA, 20 bp, synthetic construct
  source 1..20: mol_type = other DNA
agtatccgcagcagatgtgc

SEQ ID NO: 27642 - DNA, 20 bp, synthetic construct
  source 1..20: mol_type = other DNA
agtatccgggttgtcctgta

SEQ ID NO: 27643 - DNA, 20 bp, synthetic construct
  source 1..20: mol_type = other DNA
cggcgcgaagcctgcgattc

SEQ ID NO: 27644 - DNA, 20 bp, synthetic construct
  source 1..20: mol_type = other DNA
gtgctgtgtgtcctagtcta

SEQ ID NO: 27645 - DNA, 20 bp, synthetic construct
  source 1..20: mol_type = other DNA
acaacagctgtcctagtcta

SEQ ID NO: 27646 - DNA, 20 bp, synthetic construct
  source 1..20: mol_type = other DNA
ctcccggtgcttaatgcatt

SEQ ID NO: 27647 - DNA, 20 bp, synthetic construct
  source 1..20: mol_type = other DNA
tccgccactccggtaggatt

SEQ ID NO: 27648 - DNA, 20 bp, synthetic construct
  source 1..20: mol_type = other DNA
gagcgttttcccagtcggcc

SEQ ID NO: 27649 - DNA, 20 bp, synthetic construct
  source 1..20: mol_type = other DNA
gggccgaggtaccaaaggcg

SEQ ID NO: 27650 - DNA, 20 bp, synthetic construct
  source 1..20: mol_type = other DNA
attatttagtaccaaaggcg

SEQ ID NO: 27651 - DNA, 20 bp, synthetic construct
  source 1..20: mol_type = other DNA
tctccaagtcccccggtctc

SEQ ID NO: 27652 - DNA, 20 bp, synthetic construct
  source 1..20: mol_type = other DNA
gaaagtgctcccccggtctc

SEQ ID NO: 27653 - DNA, 20 bp, synthetic construct
  source 1..20: mol_type = other DNA
tcgtggaagatagtctccac

SEQ ID NO: 27654 - DNA, 20 bp, synthetic construct
  source 1..20: mol_type = other DNA
tcgtggaaacatacaagaca

SEQ ID NO: 27655 - DNA, 20 bp, synthetic construct
  source 1..20: mol_type = other DNA
ctgcctatgggcgaagtcaa

SEQ ID NO: 27656 - DNA, 20 bp, synthetic construct
  source 1..20: mol_type = other DNA
aactaagggggcgaagtcaa

SEQ ID NO: 27657 - DNA, 20 bp, synthetic construct
  source 1..20: mol_type = other DNA
caaactccgctattctgccc

SEQ ID NO: 27658 - DNA, 20 bp, synthetic construct
  source 1..20: mol_type = other DNA
tgacgctcgcgtgatgacaa

SEQ ID NO: 27659 - DNA, 20 bp, synthetic construct
  source 1..20: mol_type = other DNA
atggcagagcaaaaatgtaa

SEQ ID NO: 27660 - DNA, 20 bp, synthetic construct
  source 1..20: mol_type = other DNA
ctcaacagagccaacatttc

SEQ ID NO: 27661 - DNA, 20 bp, synthetic construct
  source 1..20: mol_type = other DNA
gaatctgcagccaacatttc

SEQ ID NO: 27662 - DNA, 20 bp, synthetic construct
  source 1..20: mol_type = other DNA
acaggagacgtcgaacttcg

SEQ ID NO: 27663 - DNA, 20 bp, synthetic construct
  source 1..20: mol_type = other DNA
acaggagagcgtactgcggt

SEQ ID NO: 27664 - DNA, 20 bp, synthetic construct
  source 1..20: mol_type = other DNA
ggcacgccgcgtactgcggt

SEQ ID NO: 27665 - DNA, 20 bp, synthetic construct
  source 1..20: mol_type = other DNA
cctttgggggctacctggct

SEQ ID NO: 27666 - DNA, 20 bp, synthetic construct
  source 1..20: mol_type = other DNA
cctttgggttgccatcagcg

SEQ ID NO: 27667 - DNA, 20 bp, synthetic construct
  source 1..20: mol_type = other DNA
cctgtgagactgcagccctg

SEQ ID NO: 27668 - DNA, 20 bp, synthetic construct
  source 1..20: mol_type = other DNA
cagatgacaacaccgtccac

SEQ ID NO: 27669 - DNA, 20 bp, synthetic construct
  source 1..20: mol_type = other DNA
atgattccctactgcgagaa

SEQ ID NO: 27670 - DNA, 20 bp, synthetic construct
  source 1..20: mol_type = other DNA
tgagtgccacaagaccaaag

SEQ ID NO: 27671 - DNA, 20 bp, synthetic construct
  source 1..20: mol_type = other DNA
aacaactaacaagaccaaag

SEQ ID NO: 27672 - DNA, 20 bp, synthetic construct
  source 1..20: mol_type = other DNA
taatttaggcattggaggag

SEQ ID NO: 27673 - DNA, 20 bp, synthetic construct
  source 1..20: mol_type = other DNA
cctaaactgcattggaggag

SEQ ID NO: 27674 - DNA, 20 bp, synthetic construct
  source 1..20: mol_type = other DNA
gcttcccactgcctagttca

SEQ ID NO: 27675 - DNA, 20 bp, synthetic construct
  source 1..20: mol_type = other DNA
ccacccccctttggatcttg

SEQ ID NO: 27676 - DNA, 20 bp, synthetic construct
  source 1..20: mol_type = other DNA
gtgcgcgagacgccgccgag

SEQ ID NO: 27677 - DNA, 20 bp, synthetic construct
  source 1..20: mol_type = other DNA
aaggagagacagtagctgat

SEQ ID NO: 27678 - DNA, 20 bp, synthetic construct
  source 1..20: mol_type = other DNA
aaggagagcattagaaaatg

SEQ ID NO: 27679 - DNA, 20 bp, synthetic construct
  source 1..20: mol_type = other DNA
acacgaaaccaaccttcaca

SEQ ID NO: 27680 - DNA, 20 bp, synthetic construct
  source 1..20: mol_type = other DNA
caatgcaataattaatcctt

SEQ ID NO: 27681 - DNA, 20 bp, synthetic construct
  source 1..20: mol_type = other DNA
ggagccaccggagccccggc

SEQ ID NO: 27682 - DNA, 20 bp, synthetic construct
  source 1..20: mol_type = other DNA
ctggccaccggagccccggc

SEQ ID NO: 27683 - DNA, 20 bp, synthetic construct
  source 1..20: mol_type = other DNA
aacccttgacaagaggacca

SEQ ID NO: 27684 - DNA, 20 bp, synthetic construct
  source 1..20: mol_type = other DNA
atactggataccaggagtta

SEQ ID NO: 27685 - DNA, 20 bp, synthetic construct
  source 1..20: mol_type = other DNA
ccgcgcgcgcgcgcgggctt

SEQ ID NO: 27686 - DNA, 20 bp, synthetic construct
  source 1..20: mol_type = other DNA
accccgaggtaacacgcgac

SEQ ID NO: 27687 - DNA, 20 bp, synthetic construct
  source 1..20: mol_type = other DNA
gaggttttgtaacacgcgac

SEQ ID NO: 27688 - DNA, 20 bp, synthetic construct
  source 1..20: mol_type = other DNA
agcgaatgtctctcctggga

SEQ ID NO: 27689 - DNA, 20 bp, synthetic construct
  source 1..20: mol_type = other DNA
agacaaatcaaactagactc

SEQ ID NO: 27690 - DNA, 20 bp, synthetic construct
  source 1..20: mol_type = other DNA
agacaaatttcgggctcgga

SEQ ID NO: 27691 - DNA, 20 bp, synthetic construct
  source 1..20: mol_type = other DNA
tgcaaatgtgccgtttccct

SEQ ID NO: 27692 - DNA, 20 bp, synthetic construct
  source 1..20: mol_type = other DNA
agatggcgccggtttactgg

SEQ ID NO: 27693 - DNA, 20 bp, synthetic construct
  source 1..20: mol_type = other DNA
agatggcggacaacatgacc

SEQ ID NO: 27694 - DNA, 20 bp, synthetic construct
  source 1..20: mol_type = other DNA
cgatcacatcattttcccaa

SEQ ID NO: 27695 - DNA, 20 bp, synthetic construct
  source 1..20: mol_type = other DNA
tgggaggcaacccagacaca

SEQ ID NO: 27696 - DNA, 20 bp, synthetic construct
  source 1..20: mol_type = other DNA
tgggaggccgtgggctggac

SEQ ID NO: 27697 - DNA, 20 bp, synthetic construct
  source 1..20: mol_type = other DNA
ggcaggcgcgggagcagcac

SEQ ID NO: 27698 - DNA, 20 bp, synthetic construct
  source 1..20: mol_type = other DNA
ccaggactggtctgagaggg

SEQ ID NO: 27699 - DNA, 20 bp, synthetic construct
  source 1..20: mol_type = other DNA
cagactgtcagataaatcgg

SEQ ID NO: 27700 - DNA, 20 bp, synthetic construct
  source 1..20: mol_type = other DNA
tgccctaccgttgcgtgagg

SEQ ID NO: 27701 - DNA, 20 bp, synthetic construct
  source 1..20: mol_type = other DNA
gtagtgggcgttgcgtgagg

SEQ ID NO: 27702 - DNA, 20 bp, synthetic construct
  source 1..20: mol_type = other DNA
gtagtggggagacaaactca

SEQ ID NO: 27703 - DNA, 20 bp, synthetic construct
  source 1..20: mol_type = other DNA
gtaggggaccaacacgtagg

SEQ ID NO: 27704 - DNA, 20 bp, synthetic construct
  source 1..20: mol_type = other DNA
tctaccccccaacacgtagg

SEQ ID NO: 27705 - DNA, 20 bp, synthetic construct
  source 1..20: mol_type = other DNA
gcctccacgcccaccacctc

SEQ ID NO: 27706 - DNA, 20 bp, synthetic construct
  source 1..20: mol_type = other DNA
taagccctgagtacagggta

SEQ ID NO: 27707 - DNA, 20 bp, synthetic construct
  source 1..20: mol_type = other DNA
gctgaagccgctgcccctgc

SEQ ID NO: 27708 - DNA, 20 bp, synthetic construct
  source 1..20: mol_type = other DNA
ccggagagcgccagggcctg

SEQ ID NO: 27709 - DNA, 20 bp, synthetic construct
  source 1..20: mol_type = other DNA
atgtggagttcgacattagg

SEQ ID NO: 27710 - DNA, 20 bp, synthetic construct
  source 1..20: mol_type = other DNA
atgtggagttcgacggtagg

SEQ ID NO: 27711 - DNA, 20 bp, synthetic construct
  source 1..20: mol_type = other DNA
atgtggagtttcctcccagg

SEQ ID NO: 27712 - DNA, 20 bp, synthetic construct
  source 1..20: mol_type = other DNA
tgtctttctttcctcccagg

SEQ ID NO: 27713 - DNA, 20 bp, synthetic construct
  source 1..20: mol_type = other DNA
gcaaggcagtggcggcggcc

SEQ ID NO: 27714 - DNA, 20 bp, synthetic construct
  source 1..20: mol_type = other DNA
caggctgggtggcggcggcc

SEQ ID NO: 27715 - DNA, 20 bp, synthetic construct
  source 1..20: mol_type = other DNA
gcaaggcatctctccattta

SEQ ID NO: 27716 - DNA, 20 bp, synthetic construct
  source 1..20: mol_type = other DNA
gcatgggcacctgaaggtct

SEQ ID NO: 27717 - DNA, 20 bp, synthetic construct
  source 1..20: mol_type = other DNA
gcatgggccaggaggccatg

SEQ ID NO: 27718 - DNA, 20 bp, synthetic construct
  source 1..20: mol_type = other DNA
tagctattcaggaggccatg

SEQ ID NO: 27719 - DNA, 20 bp, synthetic construct
  source 1..20: mol_type = other DNA
ggtaaaataagggtatgtgg

SEQ ID NO: 27720 - DNA, 20 bp, synthetic construct
  source 1..20: mol_type = other DNA
ggatgaagaagaaaacccgg

SEQ ID NO: 27721 - DNA, 20 bp, synthetic construct
  source 1..20: mol_type = other DNA
aagaactacggaacctgatg

SEQ ID NO: 27722 - DNA, 20 bp, synthetic construct
  source 1..20: mol_type = other DNA
aagaactagcccgatctgct

SEQ ID NO: 27723 - DNA, 20 bp, synthetic construct
  source 1..20: mol_type = other DNA
cagtctctcgtcatttggtg

SEQ ID NO: 27724 - DNA, 20 bp, synthetic construct
  source 1..20: mol_type = other DNA
gggaagcggagccaacatgc

SEQ ID NO: 27725 - DNA, 20 bp, synthetic construct
  source 1..20: mol_type = other DNA
attgaatcccgcttcccctt

SEQ ID NO: 27726 - DNA, 20 bp, synthetic construct
  source 1..20: mol_type = other DNA
gcagagaagcagaggaccaa

SEQ ID NO: 27727 - DNA, 20 bp, synthetic construct
  source 1..20: mol_type = other DNA
gcggaggcttccggcggaaa

SEQ ID NO: 27728 - DNA, 20 bp, synthetic construct
  source 1..20: mol_type = other DNA
aattctctttccggcggaaa

SEQ ID NO: 27729 - DNA, 20 bp, synthetic construct
  source 1..20: mol_type = other DNA
tgaatcatttcttcacatca

SEQ ID NO: 27730 - DNA, 20 bp, synthetic construct
  source 1..20: mol_type = other DNA
taaaaatcacctggaccaat

SEQ ID NO: 27731 - DNA, 20 bp, synthetic construct
  source 1..20: mol_type = other DNA
ctgaatttctaaatacaaga

SEQ ID NO: 27732 - DNA, 20 bp, synthetic construct
  source 1..20: mol_type = other DNA
gaacgttttcccctcctgga

SEQ ID NO: 27733 - DNA, 20 bp, synthetic construct
  source 1..20: mol_type = other DNA
ccccaatcttaaattagggc

SEQ ID NO: 27734 - DNA, 20 bp, synthetic construct
  source 1..20: mol_type = other DNA
gggtttctttaaattagggc

SEQ ID NO: 27735 - DNA, 20 bp, synthetic construct
  source 1..20: mol_type = other DNA
cactaatacagtgtgtggag

SEQ ID NO: 27736 - DNA, 20 bp, synthetic construct
  source 1..20: mol_type = other DNA
cggctgcctctccgcccctg

SEQ ID NO: 27737 - DNA, 20 bp, synthetic construct
  source 1..20: mol_type = other DNA
caaggtcatacatgaaatca

SEQ ID NO: 27738 - DNA, 20 bp, synthetic construct
  source 1..20: mol_type = other DNA
ttcccgtaggggccgtcggc

SEQ ID NO: 27739 - DNA, 20 bp, synthetic construct
  source 1..20: mol_type = other DNA
ttcggctgagacacgtccca

SEQ ID NO: 27740 - DNA, 20 bp, synthetic construct
  source 1..20: mol_type = other DNA
gtagcagcggggaggccggg

SEQ ID NO: 27741 - DNA, 20 bp, synthetic construct
  source 1..20: mol_type = other DNA
gtagcagctactgataaccc

SEQ ID NO: 27742 - DNA, 20 bp, synthetic construct
  source 1..20: mol_type = other DNA
tggcccactcctagtcccta

SEQ ID NO: 27743 - DNA, 20 bp, synthetic construct
  source 1..20: mol_type = other DNA
tgttaggattccagaacctt

SEQ ID NO: 27744 - DNA, 20 bp, synthetic construct
  source 1..20: mol_type = other DNA
tgttaggaaagggcgtgtgg

SEQ ID NO: 27745 - DNA, 20 bp, synthetic construct
  source 1..20: mol_type = other DNA
tcctgaccagagggtcttct

SEQ ID NO: 27746 - DNA, 20 bp, synthetic construct
  source 1..20: mol_type = other DNA
agcaggaaactcagttcttc

SEQ ID NO: 27747 - DNA, 20 bp, synthetic construct
  source 1..20: mol_type = other DNA
gtggtttcactcagttcttc

SEQ ID NO: 27748 - DNA, 20 bp, synthetic construct
  source 1..20: mol_type = other DNA
gtggctcttgccctttagac

SEQ ID NO: 27749 - DNA, 20 bp, synthetic construct
  source 1..20: mol_type = other DNA
catatgtctgccctttagac

SEQ ID NO: 27750 - DNA, 20 bp, synthetic construct
  source 1..20: mol_type = other DNA
ccagcctctccgcatcttga

SEQ ID NO: 27751 - DNA, 20 bp, synthetic construct
  source 1..20: mol_type = other DNA
ggacaaggtgccctatttag

SEQ ID NO: 27752 - DNA, 20 bp, synthetic construct
  source 1..20: mol_type = other DNA
ggtcgaggtgccctatttag

SEQ ID NO: 27753 - DNA, 20 bp, synthetic construct
  source 1..20: mol_type = other DNA
tcctcccctgccctatttag

SEQ ID NO: 27754 - DNA, 20 bp, synthetic construct
  source 1..20: mol_type = other DNA
ggtctaggtgccctatttag

SEQ ID NO: 27755 - DNA, 20 bp, synthetic construct
  source 1..20: mol_type = other DNA
ctgtggcacagtagactgta

SEQ ID NO: 27756 - DNA, 20 bp, synthetic construct
  source 1..20: mol_type = other DNA
cgcactcgatccacgctggc

SEQ ID NO: 27757 - DNA, 20 bp, synthetic construct
  source 1..20: mol_type = other DNA
acggcgacagattgtgaggt

SEQ ID NO: 27758 - DNA, 20 bp, synthetic construct
  source 1..20: mol_type = other DNA
acggcgactttactgcgaaa

SEQ ID NO: 27759 - DNA, 20 bp, synthetic construct
  source 1..20: mol_type = other DNA
cgatgttgtttactgcgaaa

SEQ ID NO: 27760 - DNA, 20 bp, synthetic construct
  source 1..20: mol_type = other DNA
ccgtgaccgacctatcaggt

SEQ ID NO: 27761 - DNA, 20 bp, synthetic construct
  source 1..20: mol_type = other DNA
ccgtgacctggggcaaccca

SEQ ID NO: 27762 - DNA, 20 bp, synthetic construct
  source 1..20: mol_type = other DNA
caagattcagaccagtgttt

SEQ ID NO: 27763 - DNA, 20 bp, synthetic construct
  source 1..20: mol_type = other DNA
atatttgtttaatgaatgtg

SEQ ID NO: 27764 - DNA, 20 bp, synthetic construct
  source 1..20: mol_type = other DNA
tctattggttggcgtttgtt

SEQ ID NO: 27765 - DNA, 20 bp, synthetic construct
  source 1..20: mol_type = other DNA
ccccctcgcttcgagcctgt

SEQ ID NO: 27766 - DNA, 20 bp, synthetic construct
  source 1..20: mol_type = other DNA
agttagactccaagaatgca

SEQ ID NO: 27767 - DNA, 20 bp, synthetic construct
  source 1..20: mol_type = other DNA
ttccagcagccgaagacacc

SEQ ID NO: 27768 - DNA, 20 bp, synthetic construct
  source 1..20: mol_type = other DNA
ccagcatggccgaagacacc

SEQ ID NO: 27769 - DNA, 20 bp, synthetic construct
  source 1..20: mol_type = other DNA
ttctctaagcctggaagtgc

SEQ ID NO: 27770 - DNA, 20 bp, synthetic construct
  source 1..20: mol_type = other DNA
cctatggggcctggaagtgc

SEQ ID NO: 27771 - DNA, 20 bp, synthetic construct
  source 1..20: mol_type = other DNA
ctcccagagcgcccggggcc

SEQ ID NO: 27772 - DNA, 20 bp, synthetic construct
  source 1..20: mol_type = other DNA
gatggcggctcccagactat

SEQ ID NO: 27773 - DNA, 20 bp, synthetic construct
  source 1..20: mol_type = other DNA
ggcagatgatttctggcctc

SEQ ID NO: 27774 - DNA, 20 bp, synthetic construct
  source 1..20: mol_type = other DNA
ctcttgctttacggcaggtg

SEQ ID NO: 27775 - DNA, 20 bp, synthetic construct
  source 1..20: mol_type = other DNA
tttcactgggtcgccatctt

SEQ ID NO: 27776 - DNA, 20 bp, synthetic construct
  source 1..20: mol_type = other DNA
gcagcagcccaacaatctcc

SEQ ID NO: 27777 - DNA, 20 bp, synthetic construct
  source 1..20: mol_type = other DNA
gcagcagcggtcgccatctt

SEQ ID NO: 27778 - DNA, 20 bp, synthetic construct
  source 1..20: mol_type = other DNA
tcctccggaagaccaggggc

SEQ ID NO: 27779 - DNA, 20 bp, synthetic construct
  source 1..20: mol_type = other DNA
cataagttaagaccaggggc

SEQ ID NO: 27780 - DNA, 20 bp, synthetic construct
  source 1..20: mol_type = other DNA
tcctccgggttcggttcctg

SEQ ID NO: 27781 - DNA, 20 bp, synthetic construct
  source 1..20: mol_type = other DNA
ctcgccgtaatagtccgacc

SEQ ID NO: 27782 - DNA, 20 bp, synthetic construct
  source 1..20: mol_type = other DNA
acgcaaacccattaaatttc

SEQ ID NO: 27783 - DNA, 20 bp, synthetic construct
  source 1..20: mol_type = other DNA
aggcccctgaacgtgtatgt

SEQ ID NO: 27784 - DNA, 20 bp, synthetic construct
  source 1..20: mol_type = other DNA
caacaaagggaagaccgacg

SEQ ID NO: 27785 - DNA, 20 bp, synthetic construct
  source 1..20: mol_type = other DNA
tgtggcttatgtccttcggt

SEQ ID NO: 27786 - DNA, 20 bp, synthetic construct
  source 1..20: mol_type = other DNA
tgtggcttggaagaccgacg

SEQ ID NO: 27787 - DNA, 20 bp, synthetic construct
  source 1..20: mol_type = other DNA
tagacgcgcctgggatgggc

SEQ ID NO: 27788 - DNA, 20 bp, synthetic construct
  source 1..20: mol_type = other DNA
gcttataaaagccctactag

SEQ ID NO: 27789 - DNA, 20 bp, synthetic construct
  source 1..20: mol_type = other DNA
ctctcacatccaggacgacc

SEQ ID NO: 27790 - DNA, 20 bp, synthetic construct
  source 1..20: mol_type = other DNA
taaccgagtgtcgccccccg

SEQ ID NO: 27791 - DNA, 20 bp, synthetic construct
  source 1..20: mol_type = other DNA
atggggggccccggccttac

SEQ ID NO: 27792 - DNA, 20 bp, synthetic construct
  source 1..20: mol_type = other DNA
tataaactccccggccttac

SEQ ID NO: 27793 - DNA, 20 bp, synthetic construct
  source 1..20: mol_type = other DNA
ccgcaggtaacaagagacac

SEQ ID NO: 27794 - DNA, 20 bp, synthetic construct
  source 1..20: mol_type = other DNA
cacagcatccgagccctcta

SEQ ID NO: 27795 - DNA, 20 bp, synthetic construct
  source 1..20: mol_type = other DNA
tctgcatcgaaaactctccg

SEQ ID NO: 27796 - DNA, 20 bp, synthetic construct
  source 1..20: mol_type = other DNA
cctaggaggaggggaggcgg

SEQ ID NO: 27797 - DNA, 20 bp, synthetic construct
  source 1..20: mol_type = other DNA
cgaccttgacggggtgctgg

SEQ ID NO: 27798 - DNA, 20 bp, synthetic construct
  source 1..20: mol_type = other DNA
cgaccttgcaaattaaaata

SEQ ID NO: 27799 - DNA, 20 bp, synthetic construct
  source 1..20: mol_type = other DNA
atttgactacggggtgctgg

SEQ ID NO: 27800 - DNA, 20 bp, synthetic construct
  source 1..20: mol_type = other DNA
tccgccaccagccctacgag

SEQ ID NO: 27801 - DNA, 20 bp, synthetic construct
  source 1..20: mol_type = other DNA
cattgatgtccggtaggatt

SEQ ID NO: 27802 - DNA, 20 bp, synthetic construct
  source 1..20: mol_type = other DNA
tctgaacttgaagcctggag

SEQ ID NO: 27803 - DNA, 20 bp, synthetic construct
  source 1..20: mol_type = other DNA
ctgggcgcctgggacccgcc

SEQ ID NO: 27804 - DNA, 20 bp, synthetic construct
  source 1..20: mol_type = other DNA
ctgggcgcggttcgtatagg

SEQ ID NO: 27805 - DNA, 20 bp, synthetic construct
  source 1..20: mol_type = other DNA
agggctagggcttcctgaac

SEQ ID NO: 27806 - DNA, 20 bp, synthetic construct
  source 1..20: mol_type = other DNA
aaaacttaggatccaagacc

SEQ ID NO: 27807 - DNA, 20 bp, synthetic construct
  source 1..20: mol_type = other DNA
taaacaagttaggcaacgcg

SEQ ID NO: 27808 - DNA, 20 bp, synthetic construct
  source 1..20: mol_type = other DNA
atccatcagggcatccaaat

SEQ ID NO: 27809 - DNA, 20 bp, synthetic construct
  source 1..20: mol_type = other DNA
ttcacggccagtttccattg

SEQ ID NO: 27810 - DNA, 20 bp, synthetic construct
  source 1..20: mol_type = other DNA
aagcgatgcagtttccattg

SEQ ID NO: 27811 - DNA, 20 bp, synthetic construct
  source 1..20: mol_type = other DNA
aagcgatgtgccacgggcga

SEQ ID NO: 27812 - DNA, 20 bp, synthetic construct
  source 1..20: mol_type = other DNA
cgttgggcgcatctcctgga

SEQ ID NO: 27813 - DNA, 20 bp, synthetic construct
  source 1..20: mol_type = other DNA
gaggacacgaccccagggca

SEQ ID NO: 27814 - DNA, 20 bp, synthetic construct
  source 1..20: mol_type = other DNA
gtgagtatgttgctattatg

SEQ ID NO: 27815 - DNA, 20 bp, synthetic construct
  source 1..20: mol_type = other DNA
gttcagcatgtgggctcaaa

SEQ ID NO: 27816 - DNA, 20 bp, synthetic construct
  source 1..20: mol_type = other DNA
ctggcagatgaggctagaaa

SEQ ID NO: 27817 - DNA, 20 bp, synthetic construct
  source 1..20: mol_type = other DNA
gataggcggagcatctagtt

SEQ ID NO: 27818 - DNA, 20 bp, synthetic construct
  source 1..20: mol_type = other DNA
acttttcagccgcggcccgg

SEQ ID NO: 27819 - DNA, 20 bp, synthetic construct
  source 1..20: mol_type = other DNA
tgaaacacgccgcggcccgg

SEQ ID NO: 27820 - DNA, 20 bp, synthetic construct
  source 1..20: mol_type = other DNA
gcagacgcccccggagtcgc

SEQ ID NO: 27821 - DNA, 20 bp, synthetic construct
  source 1..20: mol_type = other DNA
cgcgaagattccccctctgc

SEQ ID NO: 27822 - DNA, 20 bp, synthetic construct
  source 1..20: mol_type = other DNA
gccggtcacgtggggggcga

SEQ ID NO: 27823 - DNA, 20 bp, synthetic construct
  source 1..20: mol_type = other DNA
tcggttccagaagggagagg

SEQ ID NO: 27824 - DNA, 20 bp, synthetic construct
  source 1..20: mol_type = other DNA
tcggttcctccctcttagtt

SEQ ID NO: 27825 - DNA, 20 bp, synthetic construct
  source 1..20: mol_type = other DNA
gtaaagttagaagggagagg

SEQ ID NO: 27826 - DNA, 20 bp, synthetic construct
  source 1..20: mol_type = other DNA
tgtttttggcgcgtgagctc

SEQ ID NO: 27827 - DNA, 20 bp, synthetic construct
  source 1..20: mol_type = other DNA
cgcggctgtaaagtatagag

SEQ ID NO: 27828 - DNA, 20 bp, synthetic construct
  source 1..20: mol_type = other DNA
agcaagagtgggaggcgcgc

SEQ ID NO: 27829 - DNA, 20 bp, synthetic construct
  source 1..20: mol_type = other DNA
ccctgcagccctcgcctggg

SEQ ID NO: 27830 - DNA, 20 bp, synthetic construct
  source 1..20: mol_type = other DNA
tagatcaagtcgggccagct

SEQ ID NO: 27831 - DNA, 20 bp, synthetic construct
  source 1..20: mol_type = other DNA
ggcggggcgtcgggccagct

SEQ ID NO: 27832 - DNA, 20 bp, synthetic construct
  source 1..20: mol_type = other DNA
cctggtggggacagcagcca

SEQ ID NO: 27833 - DNA, 20 bp, synthetic construct
  source 1..20: mol_type = other DNA
atgcgctgactgagaagaaa

SEQ ID NO: 27834 - DNA, 20 bp, synthetic construct
  source 1..20: mol_type = other DNA
atgcgctgactgagtcctcc

SEQ ID NO: 27835 - DNA, 20 bp, synthetic construct
  source 1..20: mol_type = other DNA
gggaagggagatccggagcg

SEQ ID NO: 27836 - DNA, 20 bp, synthetic construct
  source 1..20: mol_type = other DNA
ggcgcctcgtcaaaggggct

SEQ ID NO: 27837 - DNA, 20 bp, synthetic construct
  source 1..20: mol_type = other DNA
tcaaagaagtcaaaggggct

SEQ ID NO: 27838 - DNA, 20 bp, synthetic construct
  source 1..20: mol_type = other DNA
tcaaagaatgtgtctcaaga

SEQ ID NO: 27839 - DNA, 20 bp, synthetic construct
  source 1..20: mol_type = other DNA
cggaagcttgcttaacacag

SEQ ID NO: 27840 - DNA, 20 bp, synthetic construct
  source 1..20: mol_type = other DNA
ctgcagcggaaccgactact

SEQ ID NO: 27841 - DNA, 20 bp, synthetic construct
  source 1..20: mol_type = other DNA
ggagccgggcggaattgaga

SEQ ID NO: 27842 - DNA, 20 bp, synthetic construct
  source 1..20: mol_type = other DNA
gaggagctgttatcgggact

SEQ ID NO: 27843 - DNA, 20 bp, synthetic construct
  source 1..20: mol_type = other DNA
cctcggtgggagagcagggg

SEQ ID NO: 27844 - DNA, 20 bp, synthetic construct
  source 1..20: mol_type = other DNA
aaggccgtggagagcagggg

SEQ ID NO: 27845 - DNA, 20 bp, synthetic construct
  source 1..20: mol_type = other DNA
cctcggtgcccataacatta

SEQ ID NO: 27846 - DNA, 20 bp, synthetic construct
  source 1..20: mol_type = other DNA
aatggacaaggtgtgaagag

SEQ ID NO: 27847 - DNA, 20 bp, synthetic construct
  source 1..20: mol_type = other DNA
cataaagagcagctggggta

SEQ ID NO: 27848 - DNA, 20 bp, synthetic construct
  source 1..20: mol_type = other DNA
ggccccagctgcgccatcgt

SEQ ID NO: 27849 - DNA, 20 bp, synthetic construct
  source 1..20: mol_type = other DNA
ggccccaggcagctggggta

SEQ ID NO: 27850 - DNA, 20 bp, synthetic construct
  source 1..20: mol_type = other DNA
ttttttggaggcctaggctt

SEQ ID NO: 27851 - DNA, 20 bp, synthetic construct
  source 1..20: mol_type = other DNA
taccccttcctctcggaagg

SEQ ID NO: 27852 - DNA, 20 bp, synthetic construct
  source 1..20: mol_type = other DNA
taccccttgtatatcatgaa

SEQ ID NO: 27853 - DNA, 20 bp, synthetic construct
  source 1..20: mol_type = other DNA
cctcagctcgtcctccccgc

SEQ ID NO: 27854 - DNA, 20 bp, synthetic construct
  source 1..20: mol_type = other DNA
cctcagcttagatcttgtag

SEQ ID NO: 27855 - DNA, 20 bp, synthetic construct
  source 1..20: mol_type = other DNA
gcaatgcagatccagtggtt

SEQ ID NO: 27856 - DNA, 20 bp, synthetic construct
  source 1..20: mol_type = other DNA
acggtcggattagtttgcct

SEQ ID NO: 27857 - DNA, 20 bp, synthetic construct
  source 1..20: mol_type = other DNA
gtttgaatgccctggaagga

SEQ ID NO: 27858 - DNA, 20 bp, synthetic construct
  source 1..20: mol_type = other DNA
tacgacgatctcggcaaaca

SEQ ID NO: 27859 - DNA, 20 bp, synthetic construct
  source 1..20: mol_type = other DNA
cctccgtcgagatcggcgtg

SEQ ID NO: 27860 - DNA, 20 bp, synthetic construct
  source 1..20: mol_type = other DNA
cctccgtctctcggcaaaca

SEQ ID NO: 27861 - DNA, 20 bp, synthetic construct
  source 1..20: mol_type = other DNA
cctccgttgggactaccgca

SEQ ID NO: 27862 - DNA, 20 bp, synthetic construct
  source 1..20: mol_type = other DNA
acaaacagataggttggagc

SEQ ID NO: 27863 - DNA, 20 bp, synthetic construct
  source 1..20: mol_type = other DNA
acaaacagcagatggacgct

SEQ ID NO: 27864 - DNA, 20 bp, synthetic construct
  source 1..20: mol_type = other DNA
ctagccgagtagtgttgggt

SEQ ID NO: 27865 - DNA, 20 bp, synthetic construct
  source 1..20: mol_type = other DNA
gtgtggtccgacacgatggg

SEQ ID NO: 27866 - DNA, 20 bp, synthetic construct
  source 1..20: mol_type = other DNA
gtgtggtcgacacattcacc

SEQ ID NO: 27867 - DNA, 20 bp, synthetic construct
  source 1..20: mol_type = other DNA
cgtctagccatggcgttagt

SEQ ID NO: 27868 - DNA, 20 bp, synthetic construct
  source 1..20: mol_type = other DNA
gtcgggtgcatggcgttagt

SEQ ID NO: 27869 - DNA, 20 bp, synthetic construct
  source 1..20: mol_type = other DNA
tctggctcgcctgcctgcag

SEQ ID NO: 27870 - DNA, 20 bp, synthetic construct
  source 1..20: mol_type = other DNA
ggatcctgttctaaatatcc

SEQ ID NO: 27871 - DNA, 20 bp, synthetic construct
  source 1..20: mol_type = other DNA
gaagtgctctcggcggaagt

SEQ ID NO: 27872 - DNA, 20 bp, synthetic construct
  source 1..20: mol_type = other DNA
tgcatgtggcaggagcggtg

SEQ ID NO: 27873 - DNA, 20 bp, synthetic construct
  source 1..20: mol_type = other DNA
tgcatgtgaggaataattct

SEQ ID NO: 27874 - DNA, 20 bp, synthetic construct
  source 1..20: mol_type = other DNA
aaatacacgcaggagcggtg

SEQ ID NO: 27875 - DNA, 20 bp, synthetic construct
  source 1..20: mol_type = other DNA
gccacagcattcctagactg

SEQ ID NO: 27876 - DNA, 20 bp, synthetic construct
  source 1..20: mol_type = other DNA
gcccatgtcaagattccctg

SEQ ID NO: 27877 - DNA, 20 bp, synthetic construct
  source 1..20: mol_type = other DNA
tttttaaacaagattccctg

SEQ ID NO: 27878 - DNA, 20 bp, synthetic construct
  source 1..20: mol_type = other DNA
accccgctcgcgcgccctcc

SEQ ID NO: 27879 - DNA, 20 bp, synthetic construct
  source 1..20: mol_type = other DNA
cagatcccgcccgcgtcaga

SEQ ID NO: 27880 - DNA, 20 bp, synthetic construct
  source 1..20: mol_type = other DNA
cccttctcgcccgcgtcaga

SEQ ID NO: 27881 - DNA, 20 bp, synthetic construct
  source 1..20: mol_type = other DNA
agagcggtaagatttctgcc

SEQ ID NO: 27882 - DNA, 20 bp, synthetic construct
  source 1..20: mol_type = other DNA
agagcggtaatgaatatccg

SEQ ID NO: 27883 - DNA, 20 bp, synthetic construct
  source 1..20: mol_type = other DNA
cggccggcgttgccggggta

SEQ ID NO: 27884 - DNA, 20 bp, synthetic construct
  source 1..20: mol_type = other DNA
accaaatggttgccggggta

SEQ ID NO: 27885 - DNA, 20 bp, synthetic construct
  source 1..20: mol_type = other DNA
gtatccaaagaagggggtga

SEQ ID NO: 27886 - DNA, 20 bp, synthetic construct
  source 1..20: mol_type = other DNA
tactccgaaccccagaatcc

SEQ ID NO: 27887 - DNA, 20 bp, synthetic construct
  source 1..20: mol_type = other DNA
aggggtagaccccagaatcc

SEQ ID NO: 27888 - DNA, 20 bp, synthetic construct
  source 1..20: mol_type = other DNA
gcctccctctgggcgtccac

SEQ ID NO: 27889 - DNA, 20 bp, synthetic construct
  source 1..20: mol_type = other DNA
ctgccccgccaggcgaagcg

SEQ ID NO: 27890 - DNA, 20 bp, synthetic construct
  source 1..20: mol_type = other DNA
taaatttcccaggcgaagcg

SEQ ID NO: 27891 - DNA, 20 bp, synthetic construct
  source 1..20: mol_type = other DNA
cctcgggactcggcgggtcc

SEQ ID NO: 27892 - DNA, 20 bp, synthetic construct
  source 1..20: mol_type = other DNA
gtgttcatctcggcgggtcc

SEQ ID NO: 27893 - DNA, 20 bp, synthetic construct
  source 1..20: mol_type = other DNA
tgctgctgaggaccttccag

SEQ ID NO: 27894 - DNA, 20 bp, synthetic construct
  source 1..20: mol_type = other DNA
ccgggtgcctaagcaggccc

SEQ ID NO: 27895 - DNA, 20 bp, synthetic construct
  source 1..20: mol_type = other DNA
ggcaccgcctaagcaggccc

SEQ ID NO: 27896 - DNA, 20 bp, synthetic construct
  source 1..20: mol_type = other DNA
accgccagcaggcagcggcc

SEQ ID NO: 27897 - DNA, 20 bp, synthetic construct
  source 1..20: mol_type = other DNA
ctcttggcaaaaatggcaaa

SEQ ID NO: 27898 - DNA, 20 bp, synthetic construct
  source 1..20: mol_type = other DNA
ttgacgaaacaaattttcgt

SEQ ID NO: 27899 - DNA, 20 bp, synthetic construct
  source 1..20: mol_type = other DNA
cgagacggcggcgcgtgcag

SEQ ID NO: 27900 - DNA, 20 bp, synthetic construct
  source 1..20: mol_type = other DNA
gttttgatcggcgcgtgcag

SEQ ID NO: 27901 - DNA, 20 bp, synthetic construct
  source 1..20: mol_type = other DNA
agtccaggggtggccgtgat

SEQ ID NO: 27902 - DNA, 20 bp, synthetic construct
  source 1..20: mol_type = other DNA
tccctcaagcgcagtgccca

SEQ ID NO: 27903 - DNA, 20 bp, synthetic construct
  source 1..20: mol_type = other DNA
ccgtcccagcgctaccgggc

SEQ ID NO: 27904 - DNA, 20 bp, synthetic construct
  source 1..20: mol_type = other DNA
gctggctcccggaatatgga

SEQ ID NO: 27905 - DNA, 20 bp, synthetic construct
  source 1..20: mol_type = other DNA
ttgtcaagccggaatatgga

SEQ ID NO: 27906 - DNA, 20 bp, synthetic construct
  source 1..20: mol_type = other DNA
ccgcacccttacgtatctct

SEQ ID NO: 27907 - DNA, 20 bp, synthetic construct
  source 1..20: mol_type = other DNA
tgatgtttggttcagctcgc

SEQ ID NO: 27908 - DNA, 20 bp, synthetic construct
  source 1..20: mol_type = other DNA
gtggtatctgattgttgttg

SEQ ID NO: 27909 - DNA, 20 bp, synthetic construct
  source 1..20: mol_type = other DNA
gtggtatcaaggaagctgct

SEQ ID NO: 27910 - DNA, 20 bp, synthetic construct
  source 1..20: mol_type = other DNA
tcttacaagctgcaggctct

SEQ ID NO: 27911 - DNA, 20 bp, synthetic construct
  source 1..20: mol_type = other DNA
caggctggtgactttatgaa

SEQ ID NO: 27912 - DNA, 20 bp, synthetic construct
  source 1..20: mol_type = other DNA
tggccaaccttttggctccg

SEQ ID NO: 27913 - DNA, 20 bp, synthetic construct
  source 1..20: mol_type = other DNA
gaggaggagggaaaaggcga

SEQ ID NO: 27914 - DNA, 20 bp, synthetic construct
  source 1..20: mol_type = other DNA
gaggaggacaacggctttcg

SEQ ID NO: 27915 - DNA, 20 bp, synthetic construct
  source 1..20: mol_type = other DNA
ccccgtatgggaaaaggcga

SEQ ID NO: 27916 - DNA, 20 bp, synthetic construct
  source 1..20: mol_type = other DNA
aagagtcgcgcccccgggga

SEQ ID NO: 27917 - DNA, 20 bp, synthetic construct
  source 1..20: mol_type = other DNA
tagattccagccagcccccg

SEQ ID NO: 27918 - DNA, 20 bp, synthetic construct
  source 1..20: mol_type = other DNA
gcccgcagagccagcccccg

SEQ ID NO: 27919 - DNA, 20 bp, synthetic construct
  source 1..20: mol_type = other DNA
gcccgcagcatgtcaattaa

SEQ ID NO: 27920 - DNA, 20 bp, synthetic construct
  source 1..20: mol_type = other DNA
cctggaggcgcagccccacc

SEQ ID NO: 27921 - DNA, 20 bp, synthetic construct
  source 1..20: mol_type = other DNA
gcggcaccggggcggctgcg

SEQ ID NO: 27922 - DNA, 20 bp, synthetic construct
  source 1..20: mol_type = other DNA
gccagggctgcggaggaccg

SEQ ID NO: 27923 - DNA, 20 bp, synthetic construct
  source 1..20: mol_type = other DNA
cccggggaggcgggaaatgc

SEQ ID NO: 27924 - DNA, 20 bp, synthetic construct
  source 1..20: mol_type = other DNA
cacccaacggctgccacggc

SEQ ID NO: 27925 - DNA, 20 bp, synthetic construct
  source 1..20: mol_type = other DNA
attgggcgcaactagtgtaa

SEQ ID NO: 27926 - DNA, 20 bp, synthetic construct
  source 1..20: mol_type = other DNA
ctaatcattttctctagacg

SEQ ID NO: 27927 - DNA, 20 bp, synthetic construct
  source 1..20: mol_type = other DNA
ggaggcggcgcaggcgctga

SEQ ID NO: 27928 - DNA, 20 bp, synthetic construct
  source 1..20: mol_type = other DNA
agcggccgcatgctgacatt

SEQ ID NO: 27929 - DNA, 20 bp, synthetic construct
  source 1..20: mol_type = other DNA
agcggccggggcagccttgc

SEQ ID NO: 27930 - DNA, 20 bp, synthetic construct
  source 1..20: mol_type = other DNA
tgattctaggctggtcacta

SEQ ID NO: 27931 - DNA, 20 bp, synthetic construct
  source 1..20: mol_type = other DNA
catgcttcctgctgtggctg

SEQ ID NO: 27932 - DNA, 20 bp, synthetic construct
  source 1..20: mol_type = other DNA
aggtaccccattgtatggga

SEQ ID NO: 27933 - DNA, 20 bp, synthetic construct
  source 1..20: mol_type = other DNA
cctagcgagcgagttccgcg

SEQ ID NO: 27934 - DNA, 20 bp, synthetic construct
  source 1..20: mol_type = other DNA
aagtctgaacccagcatagt

SEQ ID NO: 27935 - DNA, 20 bp, synthetic construct
  source 1..20: mol_type = other DNA
gcaaaaagcacttgtcgaca

SEQ ID NO: 27936 - DNA, 20 bp, synthetic construct
  source 1..20: mol_type = other DNA
aacaactgtgggacaacatg

SEQ ID NO: 27937 - DNA, 20 bp, synthetic construct
  source 1..20: mol_type = other DNA
gcggcccaggctgaagctca

SEQ ID NO: 27938 - DNA, 20 bp, synthetic construct
  source 1..20: mol_type = other DNA
gcggcccatctgtcgcggag

SEQ ID NO: 27939 - DNA, 20 bp, synthetic construct
  source 1..20: mol_type = other DNA
agtaagtgggctgaagctca

SEQ ID NO: 27940 - DNA, 20 bp, synthetic construct
  source 1..20: mol_type = other DNA
ctctgtgttaaaccaatcag

SEQ ID NO: 27941 - DNA, 20 bp, synthetic construct
  source 1..20: mol_type = other DNA
ttcggtaatggcctcagccc

SEQ ID NO: 27942 - DNA, 20 bp, synthetic construct
  source 1..20: mol_type = other DNA
aaccttcagagagtgcggat

SEQ ID NO: 27943 - DNA, 20 bp, synthetic construct
  source 1..20: mol_type = other DNA
ctggagcccgagagaacgaa

SEQ ID NO: 27944 - DNA, 20 bp, synthetic construct
  source 1..20: mol_type = other DNA
tccccaaatccagagggctg

SEQ ID NO: 27945 - DNA, 20 bp, synthetic construct
  source 1..20: mol_type = other DNA
atagcccaaaggacaagaaa

SEQ ID NO: 27946 - DNA, 20 bp, synthetic construct
  source 1..20: mol_type = other DNA
tgtaactgttttctgtttgg

SEQ ID NO: 27947 - DNA, 20 bp, synthetic construct
  source 1..20: mol_type = other DNA
actgcctctaagtgagcacg

SEQ ID NO: 27948 - DNA, 20 bp, synthetic construct
  source 1..20: mol_type = other DNA
gcatgtacacctgattagtt

SEQ ID NO: 27949 - DNA, 20 bp, synthetic construct
  source 1..20: mol_type = other DNA
acgtacggtccacgtcgccc

SEQ ID NO: 27950 - DNA, 20 bp, synthetic construct
  source 1..20: mol_type = other DNA
gactgttgttgtgcaattaa

SEQ ID NO: 27951 - DNA, 20 bp, synthetic construct
  source 1..20: mol_type = other DNA
atatatcgggaggaatttaa

SEQ ID NO: 27952 - DNA, 20 bp, synthetic construct
  source 1..20: mol_type = other DNA
cagggataggaggaatttaa

SEQ ID NO: 27953 - DNA, 20 bp, synthetic construct
  source 1..20: mol_type = other DNA
agtattgctgcttagttaac

SEQ ID NO: 27954 - DNA, 20 bp, synthetic construct
  source 1..20: mol_type = other DNA
atgaatcctgccgccccagc

SEQ ID NO: 27955 - DNA, 20 bp, synthetic construct
  source 1..20: mol_type = other DNA
ggggacagctttatagggga

SEQ ID NO: 27956 - DNA, 20 bp, synthetic construct
  source 1..20: mol_type = other DNA
cgtgtagcgccgcatttaaa

SEQ ID NO: 27957 - DNA, 20 bp, synthetic construct
  source 1..20: mol_type = other DNA
gagaacaagccgcatttaaa

SEQ ID NO: 27958 - DNA, 20 bp, synthetic construct
  source 1..20: mol_type = other DNA
aggtgaccacccctcgacgc

SEQ ID NO: 27959 - DNA, 20 bp, synthetic construct
  source 1..20: mol_type = other DNA
tgctcggccccgccgtcagg

SEQ ID NO: 27960 - DNA, 20 bp, synthetic construct
  source 1..20: mol_type = other DNA
tgctcggcgtgattaggttc

SEQ ID NO: 27961 - DNA, 20 bp, synthetic construct
  source 1..20: mol_type = other DNA
gccgccgctatccaggtaga

SEQ ID NO: 27962 - DNA, 20 bp, synthetic construct
  source 1..20: mol_type = other DNA
tttgctcggtcatctgctgc

SEQ ID NO: 27963 - DNA, 20 bp, synthetic construct
  source 1..20: mol_type = other DNA
ccctgactggagaaggagga

SEQ ID NO: 27964 - DNA, 20 bp, synthetic construct
  source 1..20: mol_type = other DNA
gaggaggaaagagcacctcc

SEQ ID NO: 27965 - DNA, 20 bp, synthetic construct
  source 1..20: mol_type = other DNA
gaggaggaggagaaggagga

SEQ ID NO: 27966 - DNA, 20 bp, synthetic construct
  source 1..20: mol_type = other DNA
gaattggcctgccacagaca

SEQ ID NO: 27967 - DNA, 20 bp, synthetic construct
  source 1..20: mol_type = other DNA
gaattggcgaaatgggctat

SEQ ID NO: 27968 - DNA, 20 bp, synthetic construct
  source 1..20: mol_type = other DNA
acgacaagctgccacagaca

SEQ ID NO: 27969 - DNA, 20 bp, synthetic construct
  source 1..20: mol_type = other DNA
acggtactcctgcccggcgg

SEQ ID NO: 27970 - DNA, 20 bp, synthetic construct
  source 1..20: mol_type = other DNA
gtagcccgcgcgcccctggc

SEQ ID NO: 27971 - DNA, 20 bp, synthetic construct
  source 1..20: mol_type = other DNA
tgagggacgattggcatgct

SEQ ID NO: 27972 - DNA, 20 bp, synthetic construct
  source 1..20: mol_type = other DNA
cataacctcgggtcgtaagc

SEQ ID NO: 27973 - DNA, 20 bp, synthetic construct
  source 1..20: mol_type = other DNA
cataacctgattggcatgct

SEQ ID NO: 27974 - DNA, 20 bp, synthetic construct
  source 1..20: mol_type = other DNA
tggccggagaccagggccca

SEQ ID NO: 27975 - DNA, 20 bp, synthetic construct
  source 1..20: mol_type = other DNA
ttcaaatcagttgcatatca

SEQ ID NO: 27976 - DNA, 20 bp, synthetic construct
  source 1..20: mol_type = other DNA
ttcccacaagtctcctcttc

SEQ ID NO: 27977 - DNA, 20 bp, synthetic construct
  source 1..20: mol_type = other DNA
acctttgtgtgcggtgcaac

SEQ ID NO: 27978 - DNA, 20 bp, synthetic construct
  source 1..20: mol_type = other DNA
cttgtttatttgtagtttcc

SEQ ID NO: 27979 - DNA, 20 bp, synthetic construct
  source 1..20: mol_type = other DNA
tttgaaagagcacttcccaa

SEQ ID NO: 27980 - DNA, 20 bp, synthetic construct
  source 1..20: mol_type = other DNA
agcacgtaacccaatgtgta

SEQ ID NO: 27981 - DNA, 20 bp, synthetic construct
  source 1..20: mol_type = other DNA
tgggctttagcaccagctcc

SEQ ID NO: 27982 - DNA, 20 bp, synthetic construct
  source 1..20: mol_type = other DNA
gcacacagctgtggtttatt

SEQ ID NO: 27983 - DNA, 20 bp, synthetic construct
  source 1..20: mol_type = other DNA
aaagcaggatggagctggag

SEQ ID NO: 27984 - DNA, 20 bp, synthetic construct
  source 1..20: mol_type = other DNA
gtgtatgatccgctaccagt

SEQ ID NO: 27985 - DNA, 20 bp, synthetic construct
  source 1..20: mol_type = other DNA
gcagctcggcgccacctccg

SEQ ID NO: 27986 - DNA, 20 bp, synthetic construct
  source 1..20: mol_type = other DNA
atggagaaactcctagatga

SEQ ID NO: 27987 - DNA, 20 bp, synthetic construct
  source 1..20: mol_type = other DNA
gagaaaggaaaagattagac

SEQ ID NO: 27988 - DNA, 20 bp, synthetic construct
  source 1..20: mol_type = other DNA
gagaaaggcccgcggatatg

SEQ ID NO: 27989 - DNA, 20 bp, synthetic construct
  source 1..20: mol_type = other DNA
cgcttccgaagatccgaggt

SEQ ID NO: 27990 - DNA, 20 bp, synthetic construct
  source 1..20: mol_type = other DNA
gcgcagttcccgctgtcctg

SEQ ID NO: 27991 - DNA, 20 bp, synthetic construct
  source 1..20: mol_type = other DNA
atatagctcaactgccatag

SEQ ID NO: 27992 - DNA, 20 bp, synthetic construct
  source 1..20: mol_type = other DNA
atatagctattggattggcc

SEQ ID NO: 27993 - DNA, 20 bp, synthetic construct
  source 1..20: mol_type = other DNA
ctccaggtatggtgcgcgct

SEQ ID NO: 27994 - DNA, 20 bp, synthetic construct
  source 1..20: mol_type = other DNA
attaacagtgccgccgcgcc

SEQ ID NO: 27995 - DNA, 20 bp, synthetic construct
  source 1..20: mol_type = other DNA
ggccttgtgcgctgtacttc

SEQ ID NO: 27996 - DNA, 20 bp, synthetic construct
  source 1..20: mol_type = other DNA
ttgagtatcacgcctccgga

SEQ ID NO: 27997 - DNA, 20 bp, synthetic construct
  source 1..20: mol_type = other DNA
ttgaatcaactgccagaccg

SEQ ID NO: 27998 - DNA, 20 bp, synthetic construct
  source 1..20: mol_type = other DNA
aactacatgttgtaaggctt

SEQ ID NO: 27999 - DNA, 20 bp, synthetic construct
  source 1..20: mol_type = other DNA
gtcataagtgacaagctagc

SEQ ID NO: 28000 - DNA, 20 bp, synthetic construct
  source 1..20: mol_type = other DNA
ccaggcctcactgctgagcg

SEQ ID NO: 28001 - DNA, 20 bp, synthetic construct
  source 1..20: mol_type = other DNA
ccaggccttgacaagctagc

SEQ ID NO: 28002 - DNA, 20 bp, synthetic construct
  source 1..20: mol_type = other DNA
ctggggcagggactacgaga

SEQ ID NO: 28003 - DNA, 20 bp, synthetic construct
  source 1..20: mol_type = other DNA
gaccacgtgggactacgaga

SEQ ID NO: 28004 - DNA, 20 bp, synthetic construct
  source 1..20: mol_type = other DNA
acaggctctagcttggtaga

SEQ ID NO: 28005 - DNA, 20 bp, synthetic construct
  source 1..20: mol_type = other DNA
ttctttatgtaaagacaccg

SEQ ID NO: 28006 - DNA, 20 bp, synthetic construct
  source 1..20: mol_type = other DNA
ttctttattagcttggtaga

SEQ ID NO: 28007 - DNA, 20 bp, synthetic construct
  source 1..20: mol_type = other DNA
cgcggagtcgcctcccggcc

SEQ ID NO: 28008 - DNA, 20 bp, synthetic construct
  source 1..20: mol_type = other DNA
cgcggagtgaatggagtcgg

SEQ ID NO: 28009 - DNA, 20 bp, synthetic construct
  source 1..20: mol_type = other DNA
cctcccagatttcttttaca

SEQ ID NO: 28010 - DNA, 20 bp, synthetic construct
  source 1..20: mol_type = other DNA
gagcagccgtgtggtatgat

SEQ ID NO: 28011 - DNA, 20 bp, synthetic construct
  source 1..20: mol_type = other DNA
catgtctctttgtgttcatc

SEQ ID NO: 28012 - DNA, 20 bp, synthetic construct
  source 1..20: mol_type = other DNA
tgaaagcgcgcactacacga

SEQ ID NO: 28013 - DNA, 20 bp, synthetic construct
  source 1..20: mol_type = other DNA
gtgacctcctcctcctcttt

SEQ ID NO: 28014 - DNA, 20 bp, synthetic construct
  source 1..20: mol_type = other DNA
gatccgaaaggaattggaat

SEQ ID NO: 28015 - DNA, 20 bp, synthetic construct
  source 1..20: mol_type = other DNA
ctcgtaccaggaattggaat

SEQ ID NO: 28016 - DNA, 20 bp, synthetic construct
  source 1..20: mol_type = other DNA
tatattcacaaaactgctgg

SEQ ID NO: 28017 - DNA, 20 bp, synthetic construct
  source 1..20: mol_type = other DNA
gtagtgtcgatgatctcatt

SEQ ID NO: 28018 - DNA, 20 bp, synthetic construct
  source 1..20: mol_type = other DNA
atttgtcgacaacatcttac

SEQ ID NO: 28019 - DNA, 20 bp, synthetic construct
  source 1..20: mol_type = other DNA
gggcgcccagaaggagcagg

SEQ ID NO: 28020 - DNA, 20 bp, synthetic construct
  source 1..20: mol_type = other DNA
acagctatagaaggagcagg

SEQ ID NO: 28021 - DNA, 20 bp, synthetic construct
  source 1..20: mol_type = other DNA
ctactggacagaccggaatg

SEQ ID NO: 28022 - DNA, 20 bp, synthetic construct
  source 1..20: mol_type = other DNA
ggggtgtagaggaaggaagg

SEQ ID NO: 28023 - DNA, 20 bp, synthetic construct
  source 1..20: mol_type = other DNA
tcaggtagattgttatctat

SEQ ID NO: 28024 - DNA, 20 bp, synthetic construct
  source 1..20: mol_type = other DNA
gaagcctggacccacacgcg

SEQ ID NO: 28025 - DNA, 20 bp, synthetic construct
  source 1..20: mol_type = other DNA
ctcattgccgttaaacatca

SEQ ID NO: 28026 - DNA, 20 bp, synthetic construct
  source 1..20: mol_type = other DNA
tgttaatgaaacaagccaga

SEQ ID NO: 28027 - DNA, 20 bp, synthetic construct
  source 1..20: mol_type = other DNA
cgaagcacccagataagagc

SEQ ID NO: 28028 - DNA, 20 bp, synthetic construct
  source 1..20: mol_type = other DNA
cgaagcacgactgctcccag

SEQ ID NO: 28029 - DNA, 20 bp, synthetic construct
  source 1..20: mol_type = other DNA
gcgggctgctcgcgccggct

SEQ ID NO: 28030 - DNA, 20 bp, synthetic construct
  source 1..20: mol_type = other DNA
ctttgtggtttttgtaattt

SEQ ID NO: 28031 - DNA, 20 bp, synthetic construct
  source 1..20: mol_type = other DNA
tttccgcacgcctcgaggcg

SEQ ID NO: 28032 - DNA, 20 bp, synthetic construct
  source 1..20: mol_type = other DNA
agtgtaagaaacagtaagcc

SEQ ID NO: 28033 - DNA, 20 bp, synthetic construct
  source 1..20: mol_type = other DNA
ccctcgagattacataggtc

SEQ ID NO: 28034 - DNA, 20 bp, synthetic construct
  source 1..20: mol_type = other DNA
agtagcaggccagagtctga

SEQ ID NO: 28035 - DNA, 20 bp, synthetic construct
  source 1..20: mol_type = other DNA
ccaggtgacagcggcatgga

SEQ ID NO: 28036 - DNA, 20 bp, synthetic construct
  source 1..20: mol_type = other DNA
ccaggtgatcagcagcgcac

SEQ ID NO: 28037 - DNA, 20 bp, synthetic construct
  source 1..20: mol_type = other DNA
ggccagaccagcggcatgga

SEQ ID NO: 28038 - DNA, 20 bp, synthetic construct
  source 1..20: mol_type = other DNA
caatataacaaaaaaacatg

SEQ ID NO: 28039 - DNA, 20 bp, synthetic construct
  source 1..20: mol_type = other DNA
aggcagcggaaccccccacc

SEQ ID NO: 28040 - DNA, 20 bp, synthetic construct
  source 1..20: mol_type = other DNA
ccaaccacgaaccccccacc

SEQ ID NO: 28041 - DNA, 20 bp, synthetic construct
  source 1..20: mol_type = other DNA
ttttcaacattaatactatt

SEQ ID NO: 28042 - DNA, 20 bp, synthetic construct
  source 1..20: mol_type = other DNA
acacggctattaatactatt

SEQ ID NO: 28043 - DNA, 20 bp, synthetic construct
  source 1..20: mol_type = other DNA
tgctgccgaggtaactctct

SEQ ID NO: 28044 - DNA, 20 bp, synthetic construct
  source 1..20: mol_type = other DNA
cacaggagttgtaaggcagc

SEQ ID NO: 28045 - DNA, 20 bp, synthetic construct
  source 1..20: mol_type = other DNA
cagtggatcaaatcctcatg

SEQ ID NO: 28046 - DNA, 20 bp, synthetic construct
  source 1..20: mol_type = other DNA
gttgtttcacctcagcatcc

SEQ ID NO: 28047 - DNA, 20 bp, synthetic construct
  source 1..20: mol_type = other DNA
cttacagagactggaaaaga

SEQ ID NO: 28048 - DNA, 20 bp, synthetic construct
  source 1..20: mol_type = other DNA
gtagtcctccggcccctgaa

SEQ ID NO: 28049 - DNA, 20 bp, synthetic construct
  source 1..20: mol_type = other DNA
gtagtcctggattgaagatc

SEQ ID NO: 28050 - DNA, 20 bp, synthetic construct
  source 1..20: mol_type = other DNA
cccagcctgaggaaggaagg

SEQ ID NO: 28051 - DNA, 20 bp, synthetic construct
  source 1..20: mol_type = other DNA
ttgagtatggatatcatatt

SEQ ID NO: 28052 - DNA, 20 bp, synthetic construct
  source 1..20: mol_type = other DNA
gcctactgcacgcctccgga

SEQ ID NO: 28053 - DNA, 20 bp, synthetic construct
  source 1..20: mol_type = other DNA
tcaagctcaaatgcactgga

SEQ ID NO: 28054 - DNA, 20 bp, synthetic construct
  source 1..20: mol_type = other DNA
tgagcgatttgtgcaattaa

SEQ ID NO: 28055 - DNA, 20 bp, synthetic construct
  source 1..20: mol_type = other DNA
ctgtaggaaagttaaaacca

SEQ ID NO: 28056 - DNA, 20 bp, synthetic construct
  source 1..20: mol_type = other DNA
aatagtgtctggagccggtc

SEQ ID NO: 28057 - DNA, 20 bp, synthetic construct
  source 1..20: mol_type = other DNA
agtcgaaagtattgctatag

SEQ ID NO: 28058 - DNA, 20 bp, synthetic construct
  source 1..20: mol_type = other DNA
ctctcgccgccgcccgagcg

SEQ ID NO: 28059 - DNA, 20 bp, synthetic construct
  source 1..20: mol_type = other DNA
aaaggcagaagccttcaggt

SEQ ID NO: 28060 - DNA, 20 bp, synthetic construct
  source 1..20: mol_type = other DNA
gcgactgtcaaacgttggac

SEQ ID NO: 28061 - DNA, 20 bp, synthetic construct
  source 1..20: mol_type = other DNA
atgaattagaaagaatcagg

SEQ ID NO: 28062 - DNA, 20 bp, synthetic construct
  source 1..20: mol_type = other DNA
tcacgcacgaaagaatcagg

SEQ ID NO: 28063 - DNA, 20 bp, synthetic construct
  source 1..20: mol_type = other DNA
gcaaaaagattacgtaggtc

SEQ ID NO: 28064 - DNA, 20 bp, synthetic construct
  source 1..20: mol_type = other DNA
ttgccgctattacgtaggtc

SEQ ID NO: 28065 - DNA, 20 bp, synthetic construct
  source 1..20: mol_type = other DNA
ggccccgcggagccaggttg

SEQ ID NO: 28066 - DNA, 20 bp, synthetic construct
  source 1..20: mol_type = other DNA
ccagaaggcagtgaaattcc

SEQ ID NO: 28067 - DNA, 20 bp, synthetic construct
  source 1..20: mol_type = other DNA
aaaaagacgagtatttactt

SEQ ID NO: 28068 - DNA, 20 bp, synthetic construct
  source 1..20: mol_type = other DNA
gttatgcatccacgtcgccc

SEQ ID NO: 28069 - DNA, 20 bp, synthetic construct
  source 1..20: mol_type = other DNA
tcctgttgatccgcatggtg

SEQ ID NO: 28070 - DNA, 20 bp, synthetic construct
  source 1..20: mol_type = other DNA
tcctgttgccgtttccctcc

SEQ ID NO: 28071 - DNA, 20 bp, synthetic construct
  source 1..20: mol_type = other DNA
cgagcagcttccagtcgtgt

SEQ ID NO: 28072 - DNA, 20 bp, synthetic construct
  source 1..20: mol_type = other DNA
tggccggattaacttcaaag

SEQ ID NO: 28073 - DNA, 20 bp, synthetic construct
  source 1..20: mol_type = other DNA
aaaacgcgatccaacgccga

SEQ ID NO: 28074 - DNA, 20 bp, synthetic construct
  source 1..20: mol_type = other DNA
ccacggaggcccaaggcgaa

SEQ ID NO: 28075 - DNA, 20 bp, synthetic construct
  source 1..20: mol_type = other DNA
gctgccgcccgagcccgggt

SEQ ID NO: 28076 - DNA, 20 bp, synthetic construct
  source 1..20: mol_type = other DNA
agactgttccgagcccgggt

SEQ ID NO: 28077 - DNA, 20 bp, synthetic construct
  source 1..20: mol_type = other DNA
ggctgggagagaccacccgc

SEQ ID NO: 28078 - DNA, 20 bp, synthetic construct
  source 1..20: mol_type = other DNA
ggctgggattttattgtgct

SEQ ID NO: 28079 - DNA, 20 bp, synthetic construct
  source 1..20: mol_type = other DNA
aatacatagggcgggagctg

SEQ ID NO: 28080 - DNA, 20 bp, synthetic construct
  source 1..20: mol_type = other DNA
cctagtccctgcactaggtt

SEQ ID NO: 28081 - DNA, 20 bp, synthetic construct
  source 1..20: mol_type = other DNA
ccggtgagttgcactaggtt

SEQ ID NO: 28082 - DNA, 20 bp, synthetic construct
  source 1..20: mol_type = other DNA
cctagtcctgcgtacgatac

SEQ ID NO: 28083 - DNA, 20 bp, synthetic construct
  source 1..20: mol_type = other DNA
aagctgtgctgcactaggtt

SEQ ID NO: 28084 - DNA, 20 bp, synthetic construct
  source 1..20: mol_type = other DNA
atggcttaagccctgagtac

SEQ ID NO: 28085 - DNA, 20 bp, synthetic construct
  source 1..20: mol_type = other DNA
agaacctgggttcgcgacgc

SEQ ID NO: 28086 - DNA, 20 bp, synthetic construct
  source 1..20: mol_type = other DNA
cctcggctggttcgcgacgc

SEQ ID NO: 28087 - DNA, 20 bp, synthetic construct
  source 1..20: mol_type = other DNA
aggcgcacaacgtttttcga

SEQ ID NO: 28088 - DNA, 20 bp, synthetic construct
  source 1..20: mol_type = other DNA
aaatccagtaaagaaagtgt

SEQ ID NO: 28089 - DNA, 20 bp, synthetic construct
  source 1..20: mol_type = other DNA
tgccaggtgtgaagtggagt

SEQ ID NO: 28090 - DNA, 20 bp, synthetic construct
  source 1..20: mol_type = other DNA
aatgtacagtgaagtggagt

SEQ ID NO: 28091 - DNA, 20 bp, synthetic construct
  source 1..20: mol_type = other DNA
cggcgccgagtaaataagat

SEQ ID NO: 28092 - DNA, 20 bp, synthetic construct
  source 1..20: mol_type = other DNA
cggcgccggcccccgccttc

SEQ ID NO: 28093 - DNA, 20 bp, synthetic construct
  source 1..20: mol_type = other DNA
acgacgccactatggttgat

SEQ ID NO: 28094 - DNA, 20 bp, synthetic construct
  source 1..20: mol_type = other DNA
caagtttctggtctttaaaa

SEQ ID NO: 28095 - DNA, 20 bp, synthetic construct
  source 1..20: mol_type = other DNA
tcgccgaatggtctttaaaa

SEQ ID NO: 28096 - DNA, 20 bp, synthetic construct
  source 1..20: mol_type = other DNA
cactgcccggcggactgaat

SEQ ID NO: 28097 - DNA, 20 bp, synthetic construct
  source 1..20: mol_type = other DNA
aattgattagttagatggaa

SEQ ID NO: 28098 - DNA, 20 bp, synthetic construct
  source 1..20: mol_type = other DNA
aggagacccatcgtggtata

SEQ ID NO: 28099 - DNA, 20 bp, synthetic construct
  source 1..20: mol_type = other DNA
tctgatgaagcagaaaagaa

SEQ ID NO: 28100 - DNA, 20 bp, synthetic construct
  source 1..20: mol_type = other DNA
ccgtccccgactccttcctc

SEQ ID NO: 28101 - DNA, 20 bp, synthetic construct
  source 1..20: mol_type = other DNA
aaacggtggactccttcctc

SEQ ID NO: 28102 - DNA, 20 bp, synthetic construct
  source 1..20: mol_type = other DNA
tttctttcgcagtcgtggct

SEQ ID NO: 28103 - DNA, 20 bp, synthetic construct
  source 1..20: mol_type = other DNA
ccatcagattcatcatcaac

SEQ ID NO: 28104 - DNA, 20 bp, synthetic construct
  source 1..20: mol_type = other DNA
ccatcagacgacgacgatga

SEQ ID NO: 28105 - DNA, 20 bp, synthetic construct
  source 1..20: mol_type = other DNA
tgtggcagaactcaaatgga

SEQ ID NO: 28106 - DNA, 20 bp, synthetic construct
  source 1..20: mol_type = other DNA
ataaagacctcaccggcggt

SEQ ID NO: 28107 - DNA, 20 bp, synthetic construct
  source 1..20: mol_type = other DNA
gggcctcgctcaattctaac

SEQ ID NO: 28108 - DNA, 20 bp, synthetic construct
  source 1..20: mol_type = other DNA
aatcatacaacatccacacg

SEQ ID NO: 28109 - DNA, 20 bp, synthetic construct
  source 1..20: mol_type = other DNA
gtgtaccataataaaataca

SEQ ID NO: 28110 - DNA, 20 bp, synthetic construct
  source 1..20: mol_type = other DNA
cccgtttttaataaaataca

SEQ ID NO: 28111 - DNA, 20 bp, synthetic construct
  source 1..20: mol_type = other DNA
tggagacaacatgtgggaac

SEQ ID NO: 28112 - DNA, 20 bp, synthetic construct
  source 1..20: mol_type = other DNA
actctcgtacatgtggttct

SEQ ID NO: 28113 - DNA, 20 bp, synthetic construct
  source 1..20: mol_type = other DNA
tggagacaacatgtggcaaa

SEQ ID NO: 28114 - DNA, 20 bp, synthetic construct
  source 1..20: mol_type = other DNA
tggagacacggctccccggg

SEQ ID NO: 28115 - DNA, 20 bp, synthetic construct
  source 1..20: mol_type = other DNA
tggagacatgtccacaaggc

SEQ ID NO: 28116 - DNA, 20 bp, synthetic construct
  source 1..20: mol_type = other DNA
aactatggacatgtggttct

SEQ ID NO: 28117 - DNA, 20 bp, synthetic construct
  source 1..20: mol_type = other DNA
tctaaggacgtggtttttca

SEQ ID NO: 28118 - DNA, 20 bp, synthetic construct
  source 1..20: mol_type = other DNA
tctaaggagccctccaaagt

SEQ ID NO: 28119 - DNA, 20 bp, synthetic construct
  source 1..20: mol_type = other DNA
acgaggcgagccttcttcgc

SEQ ID NO: 28120 - DNA, 20 bp, synthetic construct
  source 1..20: mol_type = other DNA
acgaggcggctgacggggcg

SEQ ID NO: 28121 - DNA, 20 bp, synthetic construct
  source 1..20: mol_type = other DNA
tacctaatgctgacggggcg

SEQ ID NO: 28122 - DNA, 20 bp, synthetic construct
  source 1..20: mol_type = other DNA
gtcaggcgtgcctggagatt

SEQ ID NO: 28123 - DNA, 20 bp, synthetic construct
  source 1..20: mol_type = other DNA
ctctcttgaccaataggcgt

SEQ ID NO: 28124 - DNA, 20 bp, synthetic construct
  source 1..20: mol_type = other DNA
aacgcccatgctcccagggg

SEQ ID NO: 28125 - DNA, 20 bp, synthetic construct
  source 1..20: mol_type = other DNA
ctgttgacgagagggttttc

SEQ ID NO: 28126 - DNA, 20 bp, synthetic construct
  source 1..20: mol_type = other DNA
ctgttgactgctcccagggg

SEQ ID NO: 28127 - DNA, 20 bp, synthetic construct
  source 1..20: mol_type = other DNA
ccagccccgaggctcagaag

SEQ ID NO: 28128 - DNA, 20 bp, synthetic construct
  source 1..20: mol_type = other DNA
cagcatgtcggtgcatggtg

SEQ ID NO: 28129 - DNA, 20 bp, synthetic construct
  source 1..20: mol_type = other DNA
tttacccgcggtgcatggtg

SEQ ID NO: 28130 - DNA, 20 bp, synthetic construct
  source 1..20: mol_type = other DNA
tcgacgcaactttctcgtcg

SEQ ID NO: 28131 - DNA, 20 bp, synthetic construct
  source 1..20: mol_type = other DNA
ggctgcggactttctcgtcg

SEQ ID NO: 28132 - DNA, 20 bp, synthetic construct
  source 1..20: mol_type = other DNA
ggctgcggcgaccgctaggc

SEQ ID NO: 28133 - DNA, 20 bp, synthetic construct
  source 1..20: mol_type = other DNA
ggcggcggggctcgcgcggg

SEQ ID NO: 28134 - DNA, 20 bp, synthetic construct
  source 1..20: mol_type = other DNA
aaacctttggctcgcgcggg

SEQ ID NO: 28135 - DNA, 20 bp, synthetic construct
  source 1..20: mol_type = other DNA
cgcccgcctgccctgccgct

SEQ ID NO: 28136 - DNA, 20 bp, synthetic construct
  source 1..20: mol_type = other DNA
tcgtgtggtgccctgccgct

SEQ ID NO: 28137 - DNA, 20 bp, synthetic construct
  source 1..20: mol_type = other DNA
tgagtcagtctgaggaaatg

SEQ ID NO: 28138 - DNA, 20 bp, synthetic construct
  source 1..20: mol_type = other DNA
gccaccgcggggcccgggtg

SEQ ID NO: 28139 - DNA, 20 bp, synthetic construct
  source 1..20: mol_type = other DNA
cgctcccgacatgccccgcc

SEQ ID NO: 28140 - DNA, 20 bp, synthetic construct
  source 1..20: mol_type = other DNA
cgctcccgacatgccccgcg

SEQ ID NO: 28141 - DNA, 20 bp, synthetic construct
  source 1..20: mol_type = other DNA
aagatttcacatgccccgcc

SEQ ID NO: 28142 - DNA, 20 bp, synthetic construct
  source 1..20: mol_type = other DNA
gtagatgccgcgcgccctcc

SEQ ID NO: 28143 - DNA, 20 bp, synthetic construct
  source 1..20: mol_type = other DNA
accccgctaatctattactg

SEQ ID NO: 28144 - DNA, 20 bp, synthetic construct
  source 1..20: mol_type = other DNA
aaagcaggtacttatgcact

SEQ ID NO: 28145 - DNA, 20 bp, synthetic construct
  source 1..20: mol_type = other DNA
tttattatatggagctggag

SEQ ID NO: 28146 - DNA, 20 bp, synthetic construct
  source 1..20: mol_type = other DNA
ccctcgccgcggtcccatgg

SEQ ID NO: 28147 - DNA, 20 bp, synthetic construct
  source 1..20: mol_type = other DNA
ttggggtgagcgaatgacaa

SEQ ID NO: 28148 - DNA, 20 bp, synthetic construct
  source 1..20: mol_type = other DNA
cgggcgcgaatgtagactta

SEQ ID NO: 28149 - DNA, 20 bp, synthetic construct
  source 1..20: mol_type = other DNA
cgggcgcgggccggcgggcg

SEQ ID NO: 28150 - DNA, 20 bp, synthetic construct
  source 1..20: mol_type = other DNA
taggcaattgcccggccatt

SEQ ID NO: 28151 - DNA, 20 bp, synthetic construct
  source 1..20: mol_type = other DNA
ccgctcaatgcccggaaatt

SEQ ID NO: 28152 - DNA, 20 bp, synthetic construct
  source 1..20: mol_type = other DNA
ccgctcaaactgaatgcccc

SEQ ID NO: 28153 - DNA, 20 bp, synthetic construct
  source 1..20: mol_type = other DNA
ccgctcaatgcccggagatt

SEQ ID NO: 28154 - DNA, 20 bp, synthetic construct
  source 1..20: mol_type = other DNA
ataggggttgcccggaaatt

SEQ ID NO: 28155 - DNA, 20 bp, synthetic construct
  source 1..20: mol_type = other DNA
cgaggcttcgtcctgcgccg

SEQ ID NO: 28156 - DNA, 20 bp, synthetic construct
  source 1..20: mol_type = other DNA
ctcactcgcacaagtggacc

SEQ ID NO: 28157 - DNA, 20 bp, synthetic construct
  source 1..20: mol_type = other DNA
aattagatcacaagtggacc

SEQ ID NO: 28158 - DNA, 20 bp, synthetic construct
  source 1..20: mol_type = other DNA
agggacacgcagtgacgagc

SEQ ID NO: 28159 - DNA, 20 bp, synthetic construct
  source 1..20: mol_type = other DNA
tgacaggacgtctggacccg

SEQ ID NO: 28160 - DNA, 20 bp, synthetic construct
  source 1..20: mol_type = other DNA
cgaataattgccgccccagc

SEQ ID NO: 28161 - DNA, 20 bp, synthetic construct
  source 1..20: mol_type = other DNA
ctctcgcagctgccacccga

SEQ ID NO: 28162 - DNA, 20 bp, synthetic construct
  source 1..20: mol_type = other DNA
ctctcgcacgacaattgtcc

SEQ ID NO: 28163 - DNA, 20 bp, synthetic construct
  source 1..20: mol_type = other DNA
gagtcatcgacccaaaaggt

SEQ ID NO: 28164 - DNA, 20 bp, synthetic construct
  source 1..20: mol_type = other DNA
cgacgttggtcgaagttcgt

SEQ ID NO: 28165 - DNA, 20 bp, synthetic construct
  source 1..20: mol_type = other DNA
gcagaggcctgagcgcctga

SEQ ID NO: 28166 - DNA, 20 bp, synthetic construct
  source 1..20: mol_type = other DNA
tcgcgaggcaaatcatcctg

SEQ ID NO: 28167 - DNA, 20 bp, synthetic construct
  source 1..20: mol_type = other DNA
tcgcgagggtttgggaggat

SEQ ID NO: 28168 - DNA, 20 bp, synthetic construct
  source 1..20: mol_type = other DNA
actgcgcggaggcacagagg

SEQ ID NO: 28169 - DNA, 20 bp, synthetic construct
  source 1..20: mol_type = other DNA
gcgccgcgcgaagtcccaat

SEQ ID NO: 28170 - DNA, 20 bp, synthetic construct
  source 1..20: mol_type = other DNA
attggtttgctcagggagga

SEQ ID NO: 28171 - DNA, 20 bp, synthetic construct
  source 1..20: mol_type = other DNA
agtcccagtggcggaggcta

SEQ ID NO: 28172 - DNA, 20 bp, synthetic construct
  source 1..20: mol_type = other DNA
gaaatctcctggagggccgg

SEQ ID NO: 28173 - DNA, 20 bp, synthetic construct
  source 1..20: mol_type = other DNA
tgtcagagacctgtaatgct

SEQ ID NO: 28174 - DNA, 20 bp, synthetic construct
  source 1..20: mol_type = other DNA
tgtcagagctggagggccgg

SEQ ID NO: 28175 - DNA, 20 bp, synthetic construct
  source 1..20: mol_type = other DNA
agcagcagcaaccactagcc

SEQ ID NO: 28176 - DNA, 20 bp, synthetic construct
  source 1..20: mol_type = other DNA
gaagggggcggagaggaagg

SEQ ID NO: 28177 - DNA, 20 bp, synthetic construct
  source 1..20: mol_type = other DNA
cagtaatagacgccgaggcg

SEQ ID NO: 28178 - DNA, 20 bp, synthetic construct
  source 1..20: mol_type = other DNA
agcatgatcggcgcccgagg

SEQ ID NO: 28179 - DNA, 20 bp, synthetic construct
  source 1..20: mol_type = other DNA
ggcagagagcacggagccgg

SEQ ID NO: 28180 - DNA, 20 bp, synthetic construct
  source 1..20: mol_type = other DNA
agacgccgcgctcagcttcc

SEQ ID NO: 28181 - DNA, 20 bp, synthetic construct
  source 1..20: mol_type = other DNA
gcgctctgtgtggccgaggc

SEQ ID NO: 28182 - DNA, 20 bp, synthetic construct
  source 1..20: mol_type = other DNA
ggcggcggcgggtgagctca

SEQ ID NO: 28183 - DNA, 20 bp, synthetic construct
  source 1..20: mol_type = other DNA
aaggtaccaggaaccgaatt

SEQ ID NO: 28184 - DNA, 20 bp, synthetic construct
  source 1..20: mol_type = other DNA
tctcagcaaagagcctggaa

SEQ ID NO: 28185 - DNA, 20 bp, synthetic construct
  source 1..20: mol_type = other DNA
tggtgggattctcagattgg

SEQ ID NO: 28186 - DNA, 20 bp, synthetic construct
  source 1..20: mol_type = other DNA
atggagaaggcgtggacgac

SEQ ID NO: 28187 - DNA, 20 bp, synthetic construct
  source 1..20: mol_type = other DNA
gcctccttactcctagatga

SEQ ID NO: 28188 - DNA, 20 bp, synthetic construct
  source 1..20: mol_type = other DNA
caaggagggacgtgttggct

SEQ ID NO: 28189 - DNA, 20 bp, synthetic construct
  source 1..20: mol_type = other DNA
agtcatcatgtacagccctg

SEQ ID NO: 28190 - DNA, 20 bp, synthetic construct
  source 1..20: mol_type = other DNA
cgaccgggagcggctgggtt

SEQ ID NO: 28191 - DNA, 20 bp, synthetic construct
  source 1..20: mol_type = other DNA
gtagccggtccttggcaaga

SEQ ID NO: 28192 - DNA, 20 bp, synthetic construct
  source 1..20: mol_type = other DNA
tccaagtcggacaccaggaa

SEQ ID NO: 28193 - DNA, 20 bp, synthetic construct
  source 1..20: mol_type = other DNA
gccctctcgctttccctctc

SEQ ID NO: 28194 - DNA, 20 bp, synthetic construct
  source 1..20: mol_type = other DNA
ggctgcagggccgctaggcc

SEQ ID NO: 28195 - DNA, 20 bp, synthetic construct
  source 1..20: mol_type = other DNA
gaaaagagtaagagtactga

SEQ ID NO: 28196 - DNA, 20 bp, synthetic construct
  source 1..20: mol_type = other DNA
ccgcttacccggcagggcgt

SEQ ID NO: 28197 - DNA, 20 bp, synthetic construct
  source 1..20: mol_type = other DNA
gcagtgggccgcctcgatcc

SEQ ID NO: 28198 - DNA, 20 bp, synthetic construct
  source 1..20: mol_type = other DNA
gcagtggggactaaacggtt

SEQ ID NO: 28199 - DNA, 20 bp, synthetic construct
  source 1..20: mol_type = other DNA
ccgctcaatacccagaaatt

SEQ ID NO: 28200 - DNA, 20 bp, synthetic construct
  source 1..20: mol_type = other DNA
gtcagtgttacccagaaatt

SEQ ID NO: 28201 - DNA, 20 bp, synthetic construct
  source 1..20: mol_type = other DNA
cagacgcggcgtggctgtga

SEQ ID NO: 28202 - DNA, 20 bp, synthetic construct
  source 1..20: mol_type = other DNA
tccatgctggaggctgggtg

SEQ ID NO: 28203 - DNA, 20 bp, synthetic construct
  source 1..20: mol_type = other DNA
accaaggaaggcagcggcag

SEQ ID NO: 28204 - DNA, 20 bp, synthetic construct
  source 1..20: mol_type = other DNA
gctggacacaccgcctccga

SEQ ID NO: 28205 - DNA, 20 bp, synthetic construct
  source 1..20: mol_type = other DNA
tggccgtgcaccgcctccga

SEQ ID NO: 28206 - DNA, 20 bp, synthetic construct
  source 1..20: mol_type = other DNA
tccttggcctgacccagaat

SEQ ID NO: 28207 - DNA, 20 bp, synthetic construct
  source 1..20: mol_type = other DNA
agtcaaaacgctccgtaacc

SEQ ID NO: 28208 - DNA, 20 bp, synthetic construct
  source 1..20: mol_type = other DNA
agtcaaaagagggttgtcaa

SEQ ID NO: 28209 - DNA, 20 bp, synthetic construct
  source 1..20: mol_type = other DNA
tgcgttggcggcctacctat

SEQ ID NO: 28210 - DNA, 20 bp, synthetic construct
  source 1..20: mol_type = other DNA
cagccctcgcctccctgccc

SEQ ID NO: 28211 - DNA, 20 bp, synthetic construct
  source 1..20: mol_type = other DNA
gcaccatgctaacttcgaac

SEQ ID NO: 28212 - DNA, 20 bp, synthetic construct
  source 1..20: mol_type = other DNA
agtttcaatcttacagttgt

SEQ ID NO: 28213 - DNA, 20 bp, synthetic construct
  source 1..20: mol_type = other DNA
aaagcggcttttggttcggc

SEQ ID NO: 28214 - DNA, 20 bp, synthetic construct
  source 1..20: mol_type = other DNA
gtgcacatttttggttcggc

SEQ ID NO: 28215 - DNA, 20 bp, synthetic construct
  source 1..20: mol_type = other DNA
cgtatgttcagatcaaaagt

SEQ ID NO: 28216 - DNA, 20 bp, synthetic construct
  source 1..20: mol_type = other DNA
atagaagccagatcaaaagt

SEQ ID NO: 28217 - DNA, 20 bp, synthetic construct
  source 1..20: mol_type = other DNA
gtgagccctgtttttgccac

SEQ ID NO: 28218 - DNA, 20 bp, synthetic construct
  source 1..20: mol_type = other DNA
gtgagcccgcaaaggattgg

SEQ ID NO: 28219 - DNA, 20 bp, synthetic construct
  source 1..20: mol_type = other DNA
cagcaagtcttttccacaat

SEQ ID NO: 28220 - DNA, 20 bp, synthetic construct
  source 1..20: mol_type = other DNA
tttacgaccttttccacaat

SEQ ID NO: 28221 - DNA, 20 bp, synthetic construct
  source 1..20: mol_type = other DNA
ctaaaatcgcgctgtacttc

SEQ ID NO: 28222 - DNA, 20 bp, synthetic construct
  source 1..20: mol_type = other DNA
attatgggctattctagatc

SEQ ID NO: 28223 - DNA, 20 bp, synthetic construct
  source 1..20: mol_type = other DNA
tgtctttataacgtcgcatc

SEQ ID NO: 28224 - DNA, 20 bp, synthetic construct
  source 1..20: mol_type = other DNA
tgtggtgaaggcgtgtaaaa

SEQ ID NO: 28225 - DNA, 20 bp, synthetic construct
  source 1..20: mol_type = other DNA
aagtctttgttttgaaagat

SEQ ID NO: 28226 - DNA, 20 bp, synthetic construct
  source 1..20: mol_type = other DNA
tgtcatttcctacctgttcg

SEQ ID NO: 28227 - DNA, 20 bp, synthetic construct
  source 1..20: mol_type = other DNA
tatgaaacttatggggatac

SEQ ID NO: 28228 - DNA, 20 bp, synthetic construct
  source 1..20: mol_type = other DNA
tagccataagagagtgggga

SEQ ID NO: 28229 - DNA, 20 bp, synthetic construct
  source 1..20: mol_type = other DNA
tggtttaaggacctcacgga

SEQ ID NO: 28230 - DNA, 20 bp, synthetic construct
  source 1..20: mol_type = other DNA
agataaataatccagtccct

SEQ ID NO: 28231 - DNA, 20 bp, synthetic construct
  source 1..20: mol_type = other DNA
tctggggaaatccagtccct

SEQ ID NO: 28232 - DNA, 20 bp, synthetic construct
  source 1..20: mol_type = other DNA
gggggcgccgcaggcgcgag

SEQ ID NO: 28233 - DNA, 20 bp, synthetic construct
  source 1..20: mol_type = other DNA
gtcacgtgccgaaaatccct

SEQ ID NO: 28234 - DNA, 20 bp, synthetic construct
  source 1..20: mol_type = other DNA
tgttgggaatcttcagccag

SEQ ID NO: 28235 - DNA, 20 bp, synthetic construct
  source 1..20: mol_type = other DNA
ctcgaagcaatgtatggccc

SEQ ID NO: 28236 - DNA, 20 bp, synthetic construct
  source 1..20: mol_type = other DNA
agactcaagggtctgtcgga

SEQ ID NO: 28237 - DNA, 20 bp, synthetic construct
  source 1..20: mol_type = other DNA
ggcaggcgtcatctacttct

SEQ ID NO: 28238 - DNA, 20 bp, synthetic construct
  source 1..20: mol_type = other DNA
attgcatacgggagcagcac

SEQ ID NO: 28239 - DNA, 20 bp, synthetic construct
  source 1..20: mol_type = other DNA
ctactgcttccctcgttcga

SEQ ID NO: 28240 - DNA, 20 bp, synthetic construct
  source 1..20: mol_type = other DNA
tcttcctcggggtagggatg

SEQ ID NO: 28241 - DNA, 20 bp, synthetic construct
  source 1..20: mol_type = other DNA
gatcgtcactaaattcagcc

SEQ ID NO: 28242 - DNA, 20 bp, synthetic construct
  source 1..20: mol_type = other DNA
gatcgtcttagtatgagaat

SEQ ID NO: 28243 - DNA, 20 bp, synthetic construct
  source 1..20: mol_type = other DNA
ttcgcggagctccctcagcc

SEQ ID NO: 28244 - DNA, 20 bp, synthetic construct
  source 1..20: mol_type = other DNA
gcgtctcgcctgcgcgggct

SEQ ID NO: 28245 - DNA, 20 bp, synthetic construct
  source 1..20: mol_type = other DNA
ctattgagctaggagggcca

SEQ ID NO: 28246 - DNA, 20 bp, synthetic construct
  source 1..20: mol_type = other DNA
gctgctccctaggagggcca

SEQ ID NO: 28247 - DNA, 20 bp, synthetic construct
  source 1..20: mol_type = other DNA
cgcggggagccaggcctcgg

SEQ ID NO: 28248 - DNA, 20 bp, synthetic construct
  source 1..20: mol_type = other DNA
aattataggccaggcctcgg

SEQ ID NO: 28249 - DNA, 20 bp, synthetic construct
  source 1..20: mol_type = other DNA
cgcggggacgggtcgtagat

SEQ ID NO: 28250 - DNA, 20 bp, synthetic construct
  source 1..20: mol_type = other DNA
ttgttaccatatagctattg

SEQ ID NO: 28251 - DNA, 20 bp, synthetic construct
  source 1..20: mol_type = other DNA
gcgccgtcggtgagtcagtc

SEQ ID NO: 28252 - DNA, 20 bp, synthetic construct
  source 1..20: mol_type = other DNA
aatccttacgcggcgcattt

SEQ ID NO: 28253 - DNA, 20 bp, synthetic construct
  source 1..20: mol_type = other DNA
cgccagcttgggaaaaggcc

SEQ ID NO: 28254 - DNA, 20 bp, synthetic construct
  source 1..20: mol_type = other DNA
tgccagcttgggaaaaggcc

SEQ ID NO: 28255 - DNA, 20 bp, synthetic construct
  source 1..20: mol_type = other DNA
tgcccactaacttaacttat

SEQ ID NO: 28256 - DNA, 20 bp, synthetic construct
  source 1..20: mol_type = other DNA
tgcccactgctcagtggagc

SEQ ID NO: 28257 - DNA, 20 bp, synthetic construct
  source 1..20: mol_type = other DNA
gggactgcaattattaacat

SEQ ID NO: 28258 - DNA, 20 bp, synthetic construct
  source 1..20: mol_type = other DNA
gggactgctcggccgcctcc

SEQ ID NO: 28259 - DNA, 20 bp, synthetic construct
  source 1..20: mol_type = other DNA
ggcactcgaggtgtgagcgg

SEQ ID NO: 28260 - DNA, 20 bp, synthetic construct
  source 1..20: mol_type = other DNA
cagctagcccaaacagcgac

SEQ ID NO: 28261 - DNA, 20 bp, synthetic construct
  source 1..20: mol_type = other DNA
caggacgctcaacccaccgt

SEQ ID NO: 28262 - DNA, 20 bp, synthetic construct
  source 1..20: mol_type = other DNA
ggttcccggggagggggcgt

SEQ ID NO: 28263 - DNA, 20 bp, synthetic construct
  source 1..20: mol_type = other DNA
ggttcccgttcgttcaatag

SEQ ID NO: 28264 - DNA, 20 bp, synthetic construct
  source 1..20: mol_type = other DNA
ccgaggacgggagggggcgt

SEQ ID NO: 28265 - DNA, 20 bp, synthetic construct
  source 1..20: mol_type = other DNA
catcctgaaagaaaacagat

SEQ ID NO: 28266 - DNA, 20 bp, synthetic construct
  source 1..20: mol_type = other DNA
catcctgacgcctcctcccc

SEQ ID NO: 28267 - DNA, 20 bp, synthetic construct
  source 1..20: mol_type = other DNA
tgcgtcagcgcctcctcccc

SEQ ID NO: 28268 - DNA, 20 bp, synthetic construct
  source 1..20: mol_type = other DNA
tgttttttctttaacctttc

SEQ ID NO: 28269 - DNA, 20 bp, synthetic construct
  source 1..20: mol_type = other DNA
gtacaccggaattgccagga

SEQ ID NO: 28270 - DNA, 20 bp, synthetic construct
  source 1..20: mol_type = other DNA
gtacaccgcgtcgagtttag

SEQ ID NO: 28271 - DNA, 20 bp, synthetic construct
  source 1..20: mol_type = other DNA
agtgtcctcaccttccaatt

SEQ ID NO: 28272 - DNA, 20 bp, synthetic construct
  source 1..20: mol_type = other DNA
tctttgattgcgtcaatcat

SEQ ID NO: 28273 - DNA, 20 bp, synthetic construct
  source 1..20: mol_type = other DNA
tcaggccccctccgcctcca

SEQ ID NO: 28274 - DNA, 20 bp, synthetic construct
  source 1..20: mol_type = other DNA
ccggtgtatcggttaggttt

SEQ ID NO: 28275 - DNA, 20 bp, synthetic construct
  source 1..20: mol_type = other DNA
taacacctcttcagtttccg

SEQ ID NO: 28276 - DNA, 20 bp, synthetic construct
  source 1..20: mol_type = other DNA
gctccggtagcagcaagttc

SEQ ID NO: 28277 - DNA, 20 bp, synthetic construct
  source 1..20: mol_type = other DNA
taaggcaaagcagcaagttc

SEQ ID NO: 28278 - DNA, 20 bp, synthetic construct
  source 1..20: mol_type = other DNA
tgttggggacctgacgctat

SEQ ID NO: 28279 - DNA, 20 bp, synthetic construct
  source 1..20: mol_type = other DNA
tgaaaattgagagtgcggat

SEQ ID NO: 28280 - DNA, 20 bp, synthetic construct
  source 1..20: mol_type = other DNA
aaccttcaattgtgagctcg

SEQ ID NO: 28281 - DNA, 20 bp, synthetic construct
  source 1..20: mol_type = other DNA
agaaagcgagacaggcaggt

SEQ ID NO: 28282 - DNA, 20 bp, synthetic construct
  source 1..20: mol_type = other DNA
tacgttaaagacaggcaggt

SEQ ID NO: 28283 - DNA, 20 bp, synthetic construct
  source 1..20: mol_type = other DNA
actcgaacctgccgctgtcg

SEQ ID NO: 28284 - DNA, 20 bp, synthetic construct
  source 1..20: mol_type = other DNA
tgcaagagggcaggctggat

SEQ ID NO: 28285 - DNA, 20 bp, synthetic construct
  source 1..20: mol_type = other DNA
ggtgtgagagcggaagtggc

SEQ ID NO: 28286 - DNA, 20 bp, synthetic construct
  source 1..20: mol_type = other DNA
cgccgccgcccggacccgcg

SEQ ID NO: 28287 - DNA, 20 bp, synthetic construct
  source 1..20: mol_type = other DNA
ctcttccgcttgcgctgccg

SEQ ID NO: 28288 - DNA, 20 bp, synthetic construct
  source 1..20: mol_type = other DNA
tggcctatcttgcgctgccg

SEQ ID NO: 28289 - DNA, 20 bp, synthetic construct
  source 1..20: mol_type = other DNA
tctagtgattccccgggata

SEQ ID NO: 28290 - DNA, 20 bp, synthetic construct
  source 1..20: mol_type = other DNA
aagtcgaggctgaaaactgt

SEQ ID NO: 28291 - DNA, 20 bp, synthetic construct
  source 1..20: mol_type = other DNA
aagtcgagttccccgggata

SEQ ID NO: 28292 - DNA, 20 bp, synthetic construct
  source 1..20: mol_type = other DNA
catgcgcagcggggccgtgg

SEQ ID NO: 28293 - DNA, 20 bp, synthetic construct
  source 1..20: mol_type = other DNA
ctcttacatcttttcctata

SEQ ID NO: 28294 - DNA, 20 bp, synthetic construct
  source 1..20: mol_type = other DNA
tggcatttcggacaaggggt

SEQ ID NO: 28295 - DNA, 20 bp, synthetic construct
  source 1..20: mol_type = other DNA
tggcattttcttttcctata

SEQ ID NO: 28296 - DNA, 20 bp, synthetic construct
  source 1..20: mol_type = other DNA
gtccccgccgccccgacgct

SEQ ID NO: 28297 - DNA, 20 bp, synthetic construct
  source 1..20: mol_type = other DNA
aggagtcacgccccgacgct

SEQ ID NO: 28298 - DNA, 20 bp, synthetic construct
  source 1..20: mol_type = other DNA
gccccgccggcggggcggtc

SEQ ID NO: 28299 - DNA, 20 bp, synthetic construct
  source 1..20: mol_type = other DNA
gggtccggcgagcatcacgc

SEQ ID NO: 28300 - DNA, 20 bp, synthetic construct
  source 1..20: mol_type = other DNA
tctgtgtcgagggcaatatt

SEQ ID NO: 28301 - DNA, 20 bp, synthetic construct
  source 1..20: mol_type = other DNA
ctgctttctgctggacgtaa

SEQ ID NO: 28302 - DNA, 20 bp, synthetic construct
  source 1..20: mol_type = other DNA
taaatccaaacattatgata

SEQ ID NO: 28303 - DNA, 20 bp, synthetic construct
  source 1..20: mol_type = other DNA
taaatccatcggccggagac

SEQ ID NO: 28304 - DNA, 20 bp, synthetic construct
  source 1..20: mol_type = other DNA
taagccctccagcggttagg

SEQ ID NO: 28305 - DNA, 20 bp, synthetic construct
  source 1..20: mol_type = other DNA
gtttaagagagtacagggta

SEQ ID NO: 28306 - DNA, 20 bp, synthetic construct
  source 1..20: mol_type = other DNA
caggtccttccccgggccct

SEQ ID NO: 28307 - DNA, 20 bp, synthetic construct
  source 1..20: mol_type = other DNA
ttttagataagttagatgtt

SEQ ID NO: 28308 - DNA, 20 bp, synthetic construct
  source 1..20: mol_type = other DNA
gtaaccgagtgattgcacat

SEQ ID NO: 28309 - DNA, 20 bp, synthetic construct
  source 1..20: mol_type = other DNA
ttcggagatctttactctac

SEQ ID NO: 28310 - DNA, 20 bp, synthetic construct
  source 1..20: mol_type = other DNA
gattctgtctgacgggcagt

SEQ ID NO: 28311 - DNA, 20 bp, synthetic construct
  source 1..20: mol_type = other DNA
ttgaaaagctgacgggcagt

SEQ ID NO: 28312 - DNA, 20 bp, synthetic construct
  source 1..20: mol_type = other DNA
atacaggccaatatcttgtt

SEQ ID NO: 28313 - DNA, 20 bp, synthetic construct
  source 1..20: mol_type = other DNA
atacaggctccctggggaag

SEQ ID NO: 28314 - DNA, 20 bp, synthetic construct
  source 1..20: mol_type = other DNA
tctggcccccaccttcttgg

SEQ ID NO: 28315 - DNA, 20 bp, synthetic construct
  source 1..20: mol_type = other DNA
acagtaccgtgcacatcagc

SEQ ID NO: 28316 - DNA, 20 bp, synthetic construct
  source 1..20: mol_type = other DNA
actcagtattaaggcttgtt

SEQ ID NO: 28317 - DNA, 20 bp, synthetic construct
  source 1..20: mol_type = other DNA
actctggtcctgatacatct

SEQ ID NO: 28318 - DNA, 20 bp, synthetic construct
  source 1..20: mol_type = other DNA
caaagcaagtaaggcttaga

SEQ ID NO: 28319 - DNA, 20 bp, synthetic construct
  source 1..20: mol_type = other DNA
taaaagaagctttgtccgat

SEQ ID NO: 28320 - DNA, 20 bp, synthetic construct
  source 1..20: mol_type = other DNA
cagcggcggcttttgctgca

SEQ ID NO: 28321 - DNA, 20 bp, synthetic construct
  source 1..20: mol_type = other DNA
gttttagagcttttgctgca

SEQ ID NO: 28322 - DNA, 20 bp, synthetic construct
  source 1..20: mol_type = other DNA
acggccgtgggaactcctcc

SEQ ID NO: 28323 - DNA, 20 bp, synthetic construct
  source 1..20: mol_type = other DNA
acggccgtatctcaaggcgt

SEQ ID NO: 28324 - DNA, 20 bp, synthetic construct
  source 1..20: mol_type = other DNA
cgccaaaagggaactcctcc

SEQ ID NO: 28325 - DNA, 20 bp, synthetic construct
  source 1..20: mol_type = other DNA
acacgcccagaggaaccttg

SEQ ID NO: 28326 - DNA, 20 bp, synthetic construct
  source 1..20: mol_type = other DNA
cataccccaaacaatccaaa

SEQ ID NO: 28327 - DNA, 20 bp, synthetic construct
  source 1..20: mol_type = other DNA
gtagagaagaaaattagtgg

SEQ ID NO: 28328 - DNA, 20 bp, synthetic construct
  source 1..20: mol_type = other DNA
gcagtaaagtatgtatatgt

SEQ ID NO: 28329 - DNA, 20 bp, synthetic construct
  source 1..20: mol_type = other DNA
ctctcgtagagggataggtg

SEQ ID NO: 28330 - DNA, 20 bp, synthetic construct
  source 1..20: mol_type = other DNA
ctctcgtatgtttcgcctcc

SEQ ID NO: 28331 - DNA, 20 bp, synthetic construct
  source 1..20: mol_type = other DNA
gaccgcgagccttgtgtgag

SEQ ID NO: 28332 - DNA, 20 bp, synthetic construct
  source 1..20: mol_type = other DNA
ttgtaaacgccttgtgtgag

SEQ ID NO: 28333 - DNA, 20 bp, synthetic construct
  source 1..20: mol_type = other DNA
cggagagcggtgcccgcgtc

SEQ ID NO: 28334 - DNA, 20 bp, synthetic construct
  source 1..20: mol_type = other DNA
gcaccttcccaggtctagca

SEQ ID NO: 28335 - DNA, 20 bp, synthetic construct
  source 1..20: mol_type = other DNA
ccctgtccagctgactgcaa

SEQ ID NO: 28336 - DNA, 20 bp, synthetic construct
  source 1..20: mol_type = other DNA
gggcagttagctgactgcaa

SEQ ID NO: 28337 - DNA, 20 bp, synthetic construct
  source 1..20: mol_type = other DNA
gtctccacctccgcctttgc

SEQ ID NO: 28338 - DNA, 20 bp, synthetic construct
  source 1..20: mol_type = other DNA
cgccgccgccgccgccgccg

SEQ ID NO: 28339 - DNA, 20 bp, synthetic construct
  source 1..20: mol_type = other DNA
tattcgtcccgccgccgccg

SEQ ID NO: 28340 - DNA, 20 bp, synthetic construct
  source 1..20: mol_type = other DNA
agggagctcccgatccgtgc

SEQ ID NO: 28341 - DNA, 20 bp, synthetic construct
  source 1..20: mol_type = other DNA
tacttaaatgcttaacgtag

SEQ ID NO: 28342 - DNA, 20 bp, synthetic construct
  source 1..20: mol_type = other DNA
aatttaaatgcttaacgtag

SEQ ID NO: 28343 - DNA, 20 bp, synthetic construct
  source 1..20: mol_type = other DNA
ttgagattttcacaacttga

SEQ ID NO: 28344 - DNA, 20 bp, synthetic construct
  source 1..20: mol_type = other DNA
gggtcaaacccgcagtaata

SEQ ID NO: 28345 - DNA, 20 bp, synthetic construct
  source 1..20: mol_type = other DNA
aagaagcgaggttcttttta

SEQ ID NO: 28346 - DNA, 20 bp, synthetic construct
  source 1..20: mol_type = other DNA
tacctcaatgcttaacacag

SEQ ID NO: 28347 - DNA, 20 bp, synthetic construct
  source 1..20: mol_type = other DNA
aagaatgcgggctgtatggc

SEQ ID NO: 28348 - DNA, 20 bp, synthetic construct
  source 1..20: mol_type = other DNA
cccctgttcctggaggcaag

SEQ ID NO: 28349 - DNA, 20 bp, synthetic construct
  source 1..20: mol_type = other DNA
ctcagaccgaccccacggag

SEQ ID NO: 28350 - DNA, 20 bp, synthetic construct
  source 1..20: mol_type = other DNA
cagtgagcgttcccaaaggg

SEQ ID NO: 28351 - DNA, 20 bp, synthetic construct
  source 1..20: mol_type = other DNA
tataatatcgacgcgttata

SEQ ID NO: 28352 - DNA, 20 bp, synthetic construct
  source 1..20: mol_type = other DNA
tataatatttttaatactgc

SEQ ID NO: 28353 - DNA, 20 bp, synthetic construct
  source 1..20: mol_type = other DNA
gcattaggttttaatactgc

SEQ ID NO: 28354 - DNA, 20 bp, synthetic construct
  source 1..20: mol_type = other DNA
ccgtacctaaggaagtagtg

SEQ ID NO: 28355 - DNA, 20 bp, synthetic construct
  source 1..20: mol_type = other DNA
ttaataagaaggaagtagtg

SEQ ID NO: 28356 - DNA, 20 bp, synthetic construct
  source 1..20: mol_type = other DNA
gtataaaatctgcaagtagt

SEQ ID NO: 28357 - DNA, 20 bp, synthetic construct
  source 1..20: mol_type = other DNA
gagcctccttctttcctgcc

SEQ ID NO: 28358 - DNA, 20 bp, synthetic construct
  source 1..20: mol_type = other DNA
acttattgtgttggagtgtc

SEQ ID NO: 28359 - DNA, 20 bp, synthetic construct
  source 1..20: mol_type = other DNA
caccacagttctggaggctg

SEQ ID NO: 28360 - DNA, 20 bp, synthetic construct
  source 1..20: mol_type = other DNA
tgtggagtttctggaggctg

SEQ ID NO: 28361 - DNA, 20 bp, synthetic construct
  source 1..20: mol_type = other DNA
gggaggagaaggcggcagcg

SEQ ID NO: 28362 - DNA, 20 bp, synthetic construct
  source 1..20: mol_type = other DNA
gggaggaggccatacgccat

SEQ ID NO: 28363 - DNA, 20 bp, synthetic construct
  source 1..20: mol_type = other DNA
gagggaggccacccatcaag

SEQ ID NO: 28364 - DNA, 20 bp, synthetic construct
  source 1..20: mol_type = other DNA
ggaagatggaaccaatcgca

SEQ ID NO: 28365 - DNA, 20 bp, synthetic construct
  source 1..20: mol_type = other DNA
gggccagccttgaactcgct

SEQ ID NO: 28366 - DNA, 20 bp, synthetic construct
  source 1..20: mol_type = other DNA
tggagagcctcttaaccgga

SEQ ID NO: 28367 - DNA, 20 bp, synthetic construct
  source 1..20: mol_type = other DNA
cccctctgctcttaaccgga

SEQ ID NO: 28368 - DNA, 20 bp, synthetic construct
  source 1..20: mol_type = other DNA
cgaggggtcccttcgcctgg

SEQ ID NO: 28369 - DNA, 20 bp, synthetic construct
  source 1..20: mol_type = other DNA
aacgttgcgtattgctacaa

SEQ ID NO: 28370 - DNA, 20 bp, synthetic construct
  source 1..20: mol_type = other DNA
aaattcttaattccattctt

SEQ ID NO: 28371 - DNA, 20 bp, synthetic construct
  source 1..20: mol_type = other DNA
tctccggtcatctactttgg

SEQ ID NO: 28372 - DNA, 20 bp, synthetic construct
  source 1..20: mol_type = other DNA
cggtgaacagctcctacccc

SEQ ID NO: 28373 - DNA, 20 bp, synthetic construct
  source 1..20: mol_type = other DNA
gaagaagagctgaggtttgc

SEQ ID NO: 28374 - DNA, 20 bp, synthetic construct
  source 1..20: mol_type = other DNA
cgccattcgagcatctagtt

SEQ ID NO: 28375 - DNA, 20 bp, synthetic construct
  source 1..20: mol_type = other DNA
gataggcgtctttatatagg

SEQ ID NO: 28376 - DNA, 20 bp, synthetic construct
  source 1..20: mol_type = other DNA
aattcctgagtgaacgaaca

SEQ ID NO: 28377 - DNA, 20 bp, synthetic construct
  source 1..20: mol_type = other DNA
catgctacaggctgttgctg

SEQ ID NO: 28378 - DNA, 20 bp, synthetic construct
  source 1..20: mol_type = other DNA
agcaattcgccagttgttgc

SEQ ID NO: 28379 - DNA, 20 bp, synthetic construct
  source 1..20: mol_type = other DNA
agttacatccatgccctaca

SEQ ID NO: 28380 - DNA, 20 bp, synthetic construct
  source 1..20: mol_type = other DNA
cgcttcactgtccctggact

SEQ ID NO: 28381 - DNA, 20 bp, synthetic construct
  source 1..20: mol_type = other DNA
ggcaggctggctgggtaccg

SEQ ID NO: 28382 - DNA, 20 bp, synthetic construct
  source 1..20: mol_type = other DNA
ggcaggctggctgggtgggt

SEQ ID NO: 28383 - DNA, 20 bp, synthetic construct
  source 1..20: mol_type = other DNA
ccagctaaggctgggtaccg

SEQ ID NO: 28384 - DNA, 20 bp, synthetic construct
  source 1..20: mol_type = other DNA
tttatatttgtatgtcttat

SEQ ID NO: 28385 - DNA, 20 bp, synthetic construct
  source 1..20: mol_type = other DNA
aaatgctagattttacttta

SEQ ID NO: 28386 - DNA, 20 bp, synthetic construct
  source 1..20: mol_type = other DNA
gctatccactgcatcatctc

SEQ ID NO: 28387 - DNA, 20 bp, synthetic construct
  source 1..20: mol_type = other DNA
ttaccattctgcatcatctc

SEQ ID NO: 28388 - DNA, 20 bp, synthetic construct
  source 1..20: mol_type = other DNA
gagtgattacctggggcgct

SEQ ID NO: 28389 - DNA, 20 bp, synthetic construct
  source 1..20: mol_type = other DNA
gagtgatttttaaaacttac

SEQ ID NO: 28390 - DNA, 20 bp, synthetic construct
  source 1..20: mol_type = other DNA
agaatccatttaaaacttac

SEQ ID NO: 28391 - DNA, 20 bp, synthetic construct
  source 1..20: mol_type = other DNA
tcgcaaccgtttgtttcata

SEQ ID NO: 28392 - DNA, 20 bp, synthetic construct
  source 1..20: mol_type = other DNA
attgccaagtttgtttcata

SEQ ID NO: 28393 - DNA, 20 bp, synthetic construct
  source 1..20: mol_type = other DNA
ggccttgttctgaatgcaca

SEQ ID NO: 28394 - DNA, 20 bp, synthetic construct
  source 1..20: mol_type = other DNA
gtgcttcaatccaatgattg

SEQ ID NO: 28395 - DNA, 20 bp, synthetic construct
  source 1..20: mol_type = other DNA
taatacggaactccatttcc

SEQ ID NO: 28396 - DNA, 20 bp, synthetic construct
  source 1..20: mol_type = other DNA
taatacggggggtgcaacga

SEQ ID NO: 28397 - DNA, 20 bp, synthetic construct
  source 1..20: mol_type = other DNA
agcactaaaactccatttcc

SEQ ID NO: 28398 - DNA, 20 bp, synthetic construct
  source 1..20: mol_type = other DNA
gagctatcaaggacaagaaa

SEQ ID NO: 28399 - DNA, 20 bp, synthetic construct
  source 1..20: mol_type = other DNA
gacctaagctaactcattaa

SEQ ID NO: 28400 - DNA, 20 bp, synthetic construct
  source 1..20: mol_type = other DNA
gagctggtcgctgtcggcta

SEQ ID NO: 28401 - DNA, 20 bp, synthetic construct
  source 1..20: mol_type = other DNA
cttgcaaccgctgtcggcta

SEQ ID NO: 28402 - DNA, 20 bp, synthetic construct
  source 1..20: mol_type = other DNA
gaagcctgcgataggtgagt

SEQ ID NO: 28403 - DNA, 20 bp, synthetic construct
  source 1..20: mol_type = other DNA
tggattccgacccacacgcg

SEQ ID NO: 28404 - DNA, 20 bp, synthetic construct
  source 1..20: mol_type = other DNA
attttattatattttattca

SEQ ID NO: 28405 - DNA, 20 bp, synthetic construct
  source 1..20: mol_type = other DNA
ttctatgaagagatgccttg

SEQ ID NO: 28406 - DNA, 20 bp, synthetic construct
  source 1..20: mol_type = other DNA
ttaatgcatttagtaattta

SEQ ID NO: 28407 - DNA, 20 bp, synthetic construct
  source 1..20: mol_type = other DNA
cagtgccacgttgtgagttg

SEQ ID NO: 28408 - DNA, 20 bp, synthetic construct
  source 1..20: mol_type = other DNA
cagtgccagacatcacaggt

SEQ ID NO: 28409 - DNA, 20 bp, synthetic construct
  source 1..20: mol_type = other DNA
ttgttacccctcgaactcct

SEQ ID NO: 28410 - DNA, 20 bp, synthetic construct
  source 1..20: mol_type = other DNA
cgacatcgaggatggcgcgt

SEQ ID NO: 28411 - DNA, 20 bp, synthetic construct
  source 1..20: mol_type = other DNA
tacttctcaggatggcgcgt

SEQ ID NO: 28412 - DNA, 20 bp, synthetic construct
  source 1..20: mol_type = other DNA
gtgatgtcaattggtcttta

SEQ ID NO: 28413 - DNA, 20 bp, synthetic construct
  source 1..20: mol_type = other DNA
caaggactttacatataagt

SEQ ID NO: 28414 - DNA, 20 bp, synthetic construct
  source 1..20: mol_type = other DNA
ggaaactccccaagggaatc

SEQ ID NO: 28415 - DNA, 20 bp, synthetic construct
  source 1..20: mol_type = other DNA
attgttatcccaagggaatc

SEQ ID NO: 28416 - DNA, 20 bp, synthetic construct
  source 1..20: mol_type = other DNA
atatacacatattggttttt

SEQ ID NO: 28417 - DNA, 20 bp, synthetic construct
  source 1..20: mol_type = other DNA
tagccacgatattggttttt

SEQ ID NO: 28418 - DNA, 20 bp, synthetic construct
  source 1..20: mol_type = other DNA
tcttccaccagaagggcctc

SEQ ID NO: 28419 - DNA, 20 bp, synthetic construct
  source 1..20: mol_type = other DNA
aaggtaggcagaagggcctc

SEQ ID NO: 28420 - DNA, 20 bp, synthetic construct
  source 1..20: mol_type = other DNA
tcttccacgcttctaaagat

SEQ ID NO: 28421 - DNA, 20 bp, synthetic construct
  source 1..20: mol_type = other DNA
ccttctaacagccaggtcat

SEQ ID NO: 28422 - DNA, 20 bp, synthetic construct
  source 1..20: mol_type = other DNA
aaggagcccagccaggtcat

SEQ ID NO: 28423 - DNA, 20 bp, synthetic construct
  source 1..20: mol_type = other DNA
attctttggttttatagcca

SEQ ID NO: 28424 - DNA, 20 bp, synthetic construct
  source 1..20: mol_type = other DNA
gttaccatcctagagacatg

SEQ ID NO: 28425 - DNA, 20 bp, synthetic construct
  source 1..20: mol_type = other DNA
cggcaacaatagctattgga

SEQ ID NO: 28426 - DNA, 20 bp, synthetic construct
  source 1..20: mol_type = other DNA
tagaggactagcaaccgtta

SEQ ID NO: 28427 - DNA, 20 bp, synthetic construct
  source 1..20: mol_type = other DNA
ctgaaggtaccccgcgcgcg

SEQ ID NO: 28428 - DNA, 20 bp, synthetic construct
  source 1..20: mol_type = other DNA
gccaacacggtacacattgt

SEQ ID NO: 28429 - DNA, 20 bp, synthetic construct
  source 1..20: mol_type = other DNA
ccggggtcggctgggacaga

SEQ ID NO: 28430 - DNA, 20 bp, synthetic construct
  source 1..20: mol_type = other DNA
cctacgacggctggtcacta

SEQ ID NO: 28431 - DNA, 20 bp, synthetic construct
  source 1..20: mol_type = other DNA
agataagactgctgtggctg

SEQ ID NO: 28432 - DNA, 20 bp, synthetic construct
  source 1..20: mol_type = other DNA
catgcttctcatgcaacacc

SEQ ID NO: 28433 - DNA, 20 bp, synthetic construct
  source 1..20: mol_type = other DNA
cactctatgattgctcctac

SEQ ID NO: 28434 - DNA, 20 bp, synthetic construct
  source 1..20: mol_type = other DNA
cactctattgcattctactt

SEQ ID NO: 28435 - DNA, 20 bp, synthetic construct
  source 1..20: mol_type = other DNA
gccccgcctctaacctaaca

SEQ ID NO: 28436 - DNA, 20 bp, synthetic construct
  source 1..20: mol_type = other DNA
tcaggcccgagtttgaatac

SEQ ID NO: 28437 - DNA, 20 bp, synthetic construct
  source 1..20: mol_type = other DNA
gtgactatcctccgcctcca

SEQ ID NO: 28438 - DNA, 20 bp, synthetic construct
  source 1..20: mol_type = other DNA
ggcgggctaataatcgaggg

SEQ ID NO: 28439 - DNA, 20 bp, synthetic construct
  source 1..20: mol_type = other DNA
cgaaggcggcccaccacctc

SEQ ID NO: 28440 - DNA, 20 bp, synthetic construct
  source 1..20: mol_type = other DNA
ctgctgctccctaatccgac

SEQ ID NO: 28441 - DNA, 20 bp, synthetic construct
  source 1..20: mol_type = other DNA
caggtcctggagtcccgtaa

SEQ ID NO: 28442 - DNA, 20 bp, synthetic construct
  source 1..20: mol_type = other DNA
ctctgtgtagccgtcccatc

SEQ ID NO: 28443 - DNA, 20 bp, synthetic construct
  source 1..20: mol_type = other DNA
cgcaccacgattggagaata

SEQ ID NO: 28444 - DNA, 20 bp, synthetic construct
  source 1..20: mol_type = other DNA
ttagtagtagatacatctaa

SEQ ID NO: 28445 - DNA, 20 bp, synthetic construct
  source 1..20: mol_type = other DNA
tgtttgctgtcttccattgg

SEQ ID NO: 28446 - DNA, 20 bp, synthetic construct
  source 1..20: mol_type = other DNA
tacaacatccgagtacctat

SEQ ID NO: 28447 - DNA, 20 bp, synthetic construct
  source 1..20: mol_type = other DNA
ccggtattcgcctcgaggcg

SEQ ID NO: 28448 - DNA, 20 bp, synthetic construct
  source 1..20: mol_type = other DNA
tttccgcatcaaggtctcga

SEQ ID NO: 28449 - DNA, 20 bp, synthetic construct
  source 1..20: mol_type = other DNA
ctctgagcttctggcaagta

SEQ ID NO: 28450 - DNA, 20 bp, synthetic construct
  source 1..20: mol_type = other DNA
ctcctggcatgccgtggttc

SEQ ID NO: 28451 - DNA, 20 bp, synthetic construct
  source 1..20: mol_type = other DNA
actgcatggccagcgctagg

SEQ ID NO: 28452 - DNA, 20 bp, synthetic construct
  source 1..20: mol_type = other DNA
cagcggccgcggtggctgag

SEQ ID NO: 28453 - DNA, 20 bp, synthetic construct
  source 1..20: mol_type = other DNA
aaggtcctactgctcacgca

SEQ ID NO: 28454 - DNA, 20 bp, synthetic construct
  source 1..20: mol_type = other DNA
aagtccagataacagccaag

SEQ ID NO: 28455 - DNA, 20 bp, synthetic construct
  source 1..20: mol_type = other DNA
tcttcgtcctgctcgcgctg

SEQ ID NO: 28456 - DNA, 20 bp, synthetic construct
  source 1..20: mol_type = other DNA
tcttcgtcgccgctctctct

SEQ ID NO: 28457 - DNA, 20 bp, synthetic construct
  source 1..20: mol_type = other DNA
ccccggccgtcgcggagcct

SEQ ID NO: 28458 - DNA, 20 bp, synthetic construct
  source 1..20: mol_type = other DNA
tctcttccggctgttcaaga

SEQ ID NO: 28459 - DNA, 20 bp, synthetic construct
  source 1..20: mol_type = other DNA
ctcgcctatttctgggctcg

SEQ ID NO: 28460 - DNA, 20 bp, synthetic construct
  source 1..20: mol_type = other DNA
gcacctgctatagctcttcc

SEQ ID NO: 28461 - DNA, 20 bp, synthetic construct
  source 1..20: mol_type = other DNA
ccgcttctgctaatcaaaac

SEQ ID NO: 28462 - DNA, 20 bp, synthetic construct
  source 1..20: mol_type = other DNA
acaacagagttttcttgaag

SEQ ID NO: 28463 - DNA, 20 bp, synthetic construct
  source 1..20: mol_type = other DNA
acaacagatcacaggattca

SEQ ID NO: 28464 - DNA, 20 bp, synthetic construct
  source 1..20: mol_type = other DNA
gaggttatgttttcttgaag

SEQ ID NO: 28465 - DNA, 20 bp, synthetic construct
  source 1..20: mol_type = other DNA
aacaatacgagcgggtcccc

SEQ ID NO: 28466 - DNA, 20 bp, synthetic construct
  source 1..20: mol_type = other DNA
aggaactccagaccttccta

SEQ ID NO: 28467 - DNA, 20 bp, synthetic construct
  source 1..20: mol_type = other DNA
aggaactcgcttttagagcc

SEQ ID NO: 28468 - DNA, 20 bp, synthetic construct
  source 1..20: mol_type = other DNA
cacggactcagaccttccta

SEQ ID NO: 28469 - DNA, 20 bp, synthetic construct
  source 1..20: mol_type = other DNA
gagggaggaagggatagcca

SEQ ID NO: 28470 - DNA, 20 bp, synthetic construct
  source 1..20: mol_type = other DNA
cagcgcgggaataagcctta

SEQ ID NO: 28471 - DNA, 20 bp, synthetic construct
  source 1..20: mol_type = other DNA
aagctctggaaagcaacgcc

SEQ ID NO: 28472 - DNA, 20 bp, synthetic construct
  source 1..20: mol_type = other DNA
tcatccgcagtgcaatttga

SEQ ID NO: 28473 - DNA, 20 bp, synthetic construct
  source 1..20: mol_type = other DNA
ctccttggggtcggcgtctg

SEQ ID NO: 28474 - DNA, 20 bp, synthetic construct
  source 1..20: mol_type = other DNA
gtacgtgtcgaaactttgcc

SEQ ID NO: 28475 - DNA, 20 bp, synthetic construct
  source 1..20: mol_type = other DNA
cgcatccacgaaactttgcc

SEQ ID NO: 28476 - DNA, 20 bp, synthetic construct
  source 1..20: mol_type = other DNA
tgattctaggctggtcacac

SEQ ID NO: 28477 - DNA, 20 bp, synthetic construct
  source 1..20: mol_type = other DNA
gcgggctgacgcataaacac

SEQ ID NO: 28478 - DNA, 20 bp, synthetic construct
  source 1..20: mol_type = other DNA
atctagtgctcgcgccggct

SEQ ID NO: 28479 - DNA, 20 bp, synthetic construct
  source 1..20: mol_type = other DNA
ctgttgaaggcctaacaacc

SEQ ID NO: 28480 - DNA, 20 bp, synthetic construct
  source 1..20: mol_type = other DNA
gctcgcttggcctaacaacc

SEQ ID NO: 28481 - DNA, 20 bp, synthetic construct
  source 1..20: mol_type = other DNA
ctgttgaacagaatcaggga

SEQ ID NO: 28482 - DNA, 20 bp, synthetic construct
  source 1..20: mol_type = other DNA
ctcggcgctacccaacctac

SEQ ID NO: 28483 - DNA, 20 bp, synthetic construct
  source 1..20: mol_type = other DNA
gcaatgtgagaggcctgcgg

SEQ ID NO: 28484 - DNA, 20 bp, synthetic construct
  source 1..20: mol_type = other DNA
ctcggcgcagaggcctgcgg

SEQ ID NO: 28485 - DNA, 20 bp, synthetic construct
  source 1..20: mol_type = other DNA
gcattgccaacaaggagaag

SEQ ID NO: 28486 - DNA, 20 bp, synthetic construct
  source 1..20: mol_type = other DNA
attggctaaacaaggagaag

SEQ ID NO: 28487 - DNA, 20 bp, synthetic construct
  source 1..20: mol_type = other DNA
atacttacaccttgtcctac

SEQ ID NO: 28488 - DNA, 20 bp, synthetic construct
  source 1..20: mol_type = other DNA
ttcgagagcctctgtcggat

SEQ ID NO: 28489 - DNA, 20 bp, synthetic construct
  source 1..20: mol_type = other DNA
tattgcatacccgtttttaa

SEQ ID NO: 28490 - DNA, 20 bp, synthetic construct
  source 1..20: mol_type = other DNA
tctggctcccaaaaagatgg

SEQ ID NO: 28491 - DNA, 20 bp, synthetic construct
  source 1..20: mol_type = other DNA
ctctcctgaacaaaagatgg

SEQ ID NO: 28492 - DNA, 20 bp, synthetic construct
  source 1..20: mol_type = other DNA
cgattgtgcacgccatgaac

SEQ ID NO: 28493 - DNA, 20 bp, synthetic construct
  source 1..20: mol_type = other DNA
actcactggtaaaggctccg

SEQ ID NO: 28494 - DNA, 20 bp, synthetic construct
  source 1..20: mol_type = other DNA
tggtggcacacgccatgaac

SEQ ID NO: 28495 - DNA, 20 bp, synthetic construct
  source 1..20: mol_type = other DNA
aatggacacaccaaatgtct

SEQ ID NO: 28496 - DNA, 20 bp, synthetic construct
  source 1..20: mol_type = other DNA
gaagcctgactagattctct

SEQ ID NO: 28497 - DNA, 20 bp, synthetic construct
  source 1..20: mol_type = other DNA
gggaaagcctttaacttggc

SEQ ID NO: 28498 - DNA, 20 bp, synthetic construct
  source 1..20: mol_type = other DNA
acagcctgctttaacttggc

SEQ ID NO: 28499 - DNA, 20 bp, synthetic construct
  source 1..20: mol_type = other DNA
agagagtgctctgagcactg

SEQ ID NO: 28500 - DNA, 20 bp, synthetic construct
  source 1..20: mol_type = other DNA
tgggtctgggtgtgagctgt

SEQ ID NO: 28501 - DNA, 20 bp, synthetic construct
  source 1..20: mol_type = other DNA
tttgttttccagtatgtacg

SEQ ID NO: 28502 - DNA, 20 bp, synthetic construct
  source 1..20: mol_type = other DNA
gagcttgtctgagtggaggc

SEQ ID NO: 28503 - DNA, 20 bp, synthetic construct
  source 1..20: mol_type = other DNA
tgaacaagggacaatctaag

SEQ ID NO: 28504 - DNA, 20 bp, synthetic construct
  source 1..20: mol_type = other DNA
ctcgaccacagatgctctga

SEQ ID NO: 28505 - DNA, 20 bp, synthetic construct
  source 1..20: mol_type = other DNA
tggtttagcagatgctctga

SEQ ID NO: 28506 - DNA, 20 bp, synthetic construct
  source 1..20: mol_type = other DNA
attgtggtataaatggaata

SEQ ID NO: 28507 - DNA, 20 bp, synthetic construct
  source 1..20: mol_type = other DNA
gccacataataaatggaata

SEQ ID NO: 28508 - DNA, 20 bp, synthetic construct
  source 1..20: mol_type = other DNA
agcggggcaaacagtgagtg

SEQ ID NO: 28509 - DNA, 20 bp, synthetic construct
  source 1..20: mol_type = other DNA
ttaccctaaaacagtgagtg

SEQ ID NO: 28510 - DNA, 20 bp, synthetic construct
  source 1..20: mol_type = other DNA
gaagaagaaggtgtcaacca

SEQ ID NO: 28511 - DNA, 20 bp, synthetic construct
  source 1..20: mol_type = other DNA
cttgctcaatgccacagcca

SEQ ID NO: 28512 - DNA, 20 bp, synthetic construct
  source 1..20: mol_type = other DNA
gaatattaaatgaaaggaga

SEQ ID NO: 28513 - DNA, 20 bp, synthetic construct
  source 1..20: mol_type = other DNA
ccgtgggcttttctgtttgg

SEQ ID NO: 28514 - DNA, 20 bp, synthetic construct
  source 1..20: mol_type = other DNA
gtgacttctagagctcagtg

SEQ ID NO: 28515 - DNA, 20 bp, synthetic construct
  source 1..20: mol_type = other DNA
acgggtgctgggacaatcgg

SEQ ID NO: 28516 - DNA, 20 bp, synthetic construct
  source 1..20: mol_type = other DNA
aggtgtgaagagcctattga

SEQ ID NO: 28517 - DNA, 20 bp, synthetic construct
  source 1..20: mol_type = other DNA
aggtgtgaccccaggtcgac

SEQ ID NO: 28518 - DNA, 20 bp, synthetic construct
  source 1..20: mol_type = other DNA
tcataaagcgaattggattg

SEQ ID NO: 28519 - DNA, 20 bp, synthetic construct
  source 1..20: mol_type = other DNA
accatatagctattggattg

SEQ ID NO: 28520 - DNA, 20 bp, synthetic construct
  source 1..20: mol_type = other DNA
tccctcggtcgagtcatcat

SEQ ID NO: 28521 - DNA, 20 bp, synthetic construct
  source 1..20: mol_type = other DNA
atcggatataagagtactga

SEQ ID NO: 28522 - DNA, 20 bp, synthetic construct
  source 1..20: mol_type = other DNA
gaaaagagggcctcagacag

SEQ ID NO: 28523 - DNA, 20 bp, synthetic construct
  source 1..20: mol_type = other DNA
agtacaccccaatctcccag

SEQ ID NO: 28524 - DNA, 20 bp, synthetic construct
  source 1..20: mol_type = other DNA
agtacaccgagcggcatgga

SEQ ID NO: 28525 - DNA, 20 bp, synthetic construct
  source 1..20: mol_type = other DNA
ccacgtacggggtgacattg

SEQ ID NO: 28526 - DNA, 20 bp, synthetic construct
  source 1..20: mol_type = other DNA
ggggtctgattcgacgtcat

SEQ ID NO: 28527 - DNA, 20 bp, synthetic construct
  source 1..20: mol_type = other DNA
gtttgcatggatccaagacc

SEQ ID NO: 28528 - DNA, 20 bp, synthetic construct
  source 1..20: mol_type = other DNA
atcatcaactgtttactccc

SEQ ID NO: 28529 - DNA, 20 bp, synthetic construct
  source 1..20: mol_type = other DNA
gagacccaggtcgaggtccg

SEQ ID NO: 28530 - DNA, 20 bp, synthetic construct
  source 1..20: mol_type = other DNA
ccgcaggttgtgtagagtcg

SEQ ID NO: 28531 - DNA, 20 bp, synthetic construct
  source 1..20: mol_type = other DNA
ggttaaaaatagttttaata

SEQ ID NO: 28532 - DNA, 20 bp, synthetic construct
  source 1..20: mol_type = other DNA
cgaatatcgttggagaattc

SEQ ID NO: 28533 - DNA, 20 bp, synthetic construct
  source 1..20: mol_type = other DNA
aggtcccgagaccagtgttt

SEQ ID NO: 28534 - DNA, 20 bp, synthetic construct
  source 1..20: mol_type = other DNA
caagattcgagttgtgaacg

SEQ ID NO: 28535 - DNA, 20 bp, synthetic construct
  source 1..20: mol_type = other DNA
atatctcagggagctggcga

SEQ ID NO: 28536 - DNA, 20 bp, synthetic construct
  source 1..20: mol_type = other DNA
atatctcattttctaacttc

SEQ ID NO: 28537 - DNA, 20 bp, synthetic construct
  source 1..20: mol_type = other DNA
cgtgcatgattgagatagtc

SEQ ID NO: 28538 - DNA, 20 bp, synthetic construct
  source 1..20: mol_type = other DNA
tcagttcagtcgagtggtgg

SEQ ID NO: 28539 - DNA, 20 bp, synthetic construct
  source 1..20: mol_type = other DNA
tcagttcaaatatcgacctc

SEQ ID NO: 28540 - DNA, 20 bp, synthetic construct
  source 1..20: mol_type = other DNA
tttaagctcaaactgcttaa

SEQ ID NO: 28541 - DNA, 20 bp, synthetic construct
  source 1..20: mol_type = other DNA
gcataccctcttttaataaa

SEQ ID NO: 28542 - DNA, 20 bp, synthetic construct
  source 1..20: mol_type = other DNA
gccttctcctataaattcta

SEQ ID NO: 28543 - DNA, 20 bp, synthetic construct
  source 1..20: mol_type = other DNA
taaagaggagccccgccagc

SEQ ID NO: 28544 - DNA, 20 bp, synthetic construct
  source 1..20: mol_type = other DNA
gttctttgggaacgctctcg

SEQ ID NO: 28545 - DNA, 20 bp, synthetic construct
  source 1..20: mol_type = other DNA
ccctggaaggaacgctctcg

SEQ ID NO: 28546 - DNA, 20 bp, synthetic construct
  source 1..20: mol_type = other DNA
actcaacaatttctccaaca

SEQ ID NO: 28547 - DNA, 20 bp, synthetic construct
  source 1..20: mol_type = other DNA
gccctacgtcgggggctccc

SEQ ID NO: 28548 - DNA, 20 bp, synthetic construct
  source 1..20: mol_type = other DNA
tggcacaactggggagtgac

SEQ ID NO: 28549 - DNA, 20 bp, synthetic construct
  source 1..20: mol_type = other DNA
gtctgcagggtactcagcgg

SEQ ID NO: 28550 - DNA, 20 bp, synthetic construct
  source 1..20: mol_type = other DNA
acacgctttagctcgcgttt

SEQ ID NO: 28551 - DNA, 20 bp, synthetic construct
  source 1..20: mol_type = other DNA
ctctatgcccctggattggc

SEQ ID NO: 28552 - DNA, 20 bp, synthetic construct
  source 1..20: mol_type = other DNA
aacggaaaatcccgttgtaa

SEQ ID NO: 28553 - DNA, 20 bp, synthetic construct
  source 1..20: mol_type = other DNA
ggacctggatcatcggccgt

SEQ ID NO: 28554 - DNA, 20 bp, synthetic construct
  source 1..20: mol_type = other DNA
ttccccttagttggcccaga

SEQ ID NO: 28555 - DNA, 20 bp, synthetic construct
  source 1..20: mol_type = other DNA
gggtggggtccctcaagttg

SEQ ID NO: 28556 - DNA, 20 bp, synthetic construct
  source 1..20: mol_type = other DNA
caagggtacattttttttca

SEQ ID NO: 28557 - DNA, 20 bp, synthetic construct
  source 1..20: mol_type = other DNA
aagaccagatcaattaaatg

SEQ ID NO: 28558 - DNA, 20 bp, synthetic construct
  source 1..20: mol_type = other DNA
agaaatgaggacctcagttg

SEQ ID NO: 28559 - DNA, 20 bp, synthetic construct
  source 1..20: mol_type = other DNA
ttgcggcgatgaaatgaaat

SEQ ID NO: 28560 - DNA, 20 bp, synthetic construct
  source 1..20: mol_type = other DNA
tcccagccaatagaaagtga

SEQ ID NO: 28561 - DNA, 20 bp, synthetic construct
  source 1..20: mol_type = other DNA
gcctccctccagcgacggcc

SEQ ID NO: 28562 - DNA, 20 bp, synthetic construct
  source 1..20: mol_type = other DNA
tggacaaagcctacgccggt

SEQ ID NO: 28563 - DNA, 20 bp, synthetic construct
  source 1..20: mol_type = other DNA
ggcggcccgcagcgggataa

SEQ ID NO: 28564 - DNA, 20 bp, synthetic construct
  source 1..20: mol_type = other DNA
taagtgaggcactagaacga

SEQ ID NO: 28565 - DNA, 20 bp, synthetic construct
  source 1..20: mol_type = other DNA
aagccccagcgctctagagc

SEQ ID NO: 28566 - DNA, 20 bp, synthetic construct
  source 1..20: mol_type = other DNA
ggttgtggttctgcatgttt

SEQ ID NO: 28567 - DNA, 20 bp, synthetic construct
  source 1..20: mol_type = other DNA
caattgtgttttacttgtca

SEQ ID NO: 28568 - DNA, 20 bp, synthetic construct
  source 1..20: mol_type = other DNA
caattgtggggccaaaccac

SEQ ID NO: 28569 - DNA, 20 bp, synthetic construct
  source 1..20: mol_type = other DNA
aaaacatccactccctgtaa

SEQ ID NO: 28570 - DNA, 20 bp, synthetic construct
  source 1..20: mol_type = other DNA
tccggtcacactccctgtaa

SEQ ID NO: 28571 - DNA, 20 bp, synthetic construct
  source 1..20: mol_type = other DNA
aatatccccacaagctgttt

SEQ ID NO: 28572 - DNA, 20 bp, synthetic construct
  source 1..20: mol_type = other DNA
cctcggcttgggtaaggcga

SEQ ID NO: 28573 - DNA, 20 bp, synthetic construct
  source 1..20: mol_type = other DNA
ggcacaaatgggtaaggcga

SEQ ID NO: 28574 - DNA, 20 bp, synthetic construct
  source 1..20: mol_type = other DNA
cctcggctgcccgttccacg

SEQ ID NO: 28575 - DNA, 20 bp, synthetic construct
  source 1..20: mol_type = other DNA
tgaaacacacaagaggacca

SEQ ID NO: 28576 - DNA, 20 bp, synthetic construct
  source 1..20: mol_type = other DNA
ccactcaattatgtcataag

SEQ ID NO: 28577 - DNA, 20 bp, synthetic construct
  source 1..20: mol_type = other DNA
aaagaaagcaataaaattaa

SEQ ID NO: 28578 - DNA, 20 bp, synthetic construct
  source 1..20: mol_type = other DNA
ggctgacctgctttgccttg

SEQ ID NO: 28579 - DNA, 20 bp, synthetic construct
  source 1..20: mol_type = other DNA
agacacaagcatacttctgc

SEQ ID NO: 28580 - DNA, 20 bp, synthetic construct
  source 1..20: mol_type = other DNA
catgctttgcatacttctgc

SEQ ID NO: 28581 - DNA, 20 bp, synthetic construct
  source 1..20: mol_type = other DNA
cacaacaccaacagaagacc

SEQ ID NO: 28582 - DNA, 20 bp, synthetic construct
  source 1..20: mol_type = other DNA
gtcacgtggattcttcaggg

SEQ ID NO: 28583 - DNA, 20 bp, synthetic construct
  source 1..20: mol_type = other DNA
ggagcatgatagtaataatt

SEQ ID NO: 28584 - DNA, 20 bp, synthetic construct
  source 1..20: mol_type = other DNA
ttacggagtattttgtccgc

SEQ ID NO: 28585 - DNA, 20 bp, synthetic construct
  source 1..20: mol_type = other DNA
ttaacaaggtcgacagcgcc

SEQ ID NO: 28586 - DNA, 20 bp, synthetic construct
  source 1..20: mol_type = other DNA
cgtcacttcgtttgtaacaa

SEQ ID NO: 28587 - DNA, 20 bp, synthetic construct
  source 1..20: mol_type = other DNA
gtcccatgcgtcctctgccc

SEQ ID NO: 28588 - DNA, 20 bp, synthetic construct
  source 1..20: mol_type = other DNA
gtcccatgatagagagtgaa

SEQ ID NO: 28589 - DNA, 20 bp, synthetic construct
  source 1..20: mol_type = other DNA
aagttcgccgtcctctgccc

SEQ ID NO: 28590 - DNA, 20 bp, synthetic construct
  source 1..20: mol_type = other DNA
gtagtaggcttcagacttga

SEQ ID NO: 28591 - DNA, 20 bp, synthetic construct
  source 1..20: mol_type = other DNA
aaagccactgttgttgttac

SEQ ID NO: 28592 - DNA, 20 bp, synthetic construct
  source 1..20: mol_type = other DNA
ggaaaaggacaagatatttg

SEQ ID NO: 28593 - DNA, 20 bp, synthetic construct
  source 1..20: mol_type = other DNA
ggaaaaggcgccaggcccct

SEQ ID NO: 28594 - DNA, 20 bp, synthetic construct
  source 1..20: mol_type = other DNA
cgggtattctatagccggcg

SEQ ID NO: 28595 - DNA, 20 bp, synthetic construct
  source 1..20: mol_type = other DNA
gccgtttcgtagtgaccggc

SEQ ID NO: 28596 - DNA, 20 bp, synthetic construct
  source 1..20: mol_type = other DNA
tttctttcgtagtgttcttt

SEQ ID NO: 28597 - DNA, 20 bp, synthetic construct
  source 1..20: mol_type = other DNA
agacacctagggatcgtcaa

SEQ ID NO: 28598 - DNA, 20 bp, synthetic construct
  source 1..20: mol_type = other DNA
ccccacctagggattactcc

SEQ ID NO: 28599 - DNA, 20 bp, synthetic construct
  source 1..20: mol_type = other DNA
tggcaaatagggatttcttg

SEQ ID NO: 28600 - DNA, 20 bp, synthetic construct
  source 1..20: mol_type = other DNA
cgggtcctagggatccggcg

SEQ ID NO: 28601 - DNA, 20 bp, synthetic construct
  source 1..20: mol_type = other DNA
aattcctttaggatcgtcaa

SEQ ID NO: 28602 - DNA, 20 bp, synthetic construct
  source 1..20: mol_type = other DNA
gaatcgagaaaagccacgga

SEQ ID NO: 28603 - DNA, 20 bp, synthetic construct
  source 1..20: mol_type = other DNA
aattcctttaaagccgtcaa

SEQ ID NO: 28604 - DNA, 20 bp, synthetic construct
  source 1..20: mol_type = other DNA
ttccggggagaagccacgga

SEQ ID NO: 28605 - DNA, 20 bp, synthetic construct
  source 1..20: mol_type = other DNA
ttccggggagaagccgtcaa

SEQ ID NO: 28606 - DNA, 20 bp, synthetic construct
  source 1..20: mol_type = other DNA
tggcaaagagaagcttcttg

SEQ ID NO: 28607 - DNA, 20 bp, synthetic construct
  source 1..20: mol_type = other DNA
ccccggggagaagctactcc

SEQ ID NO: 28608 - DNA, 20 bp, synthetic construct
  source 1..20: mol_type = other DNA
gaatcgagaaaggacacgga

SEQ ID NO: 28609 - DNA, 20 bp, synthetic construct
  source 1..20: mol_type = other DNA
aattcctttaaggacgtcaa

SEQ ID NO: 28610 - DNA, 20 bp, synthetic construct
  source 1..20: mol_type = other DNA
gccgtctccaaggaaccggc

SEQ ID NO: 28611 - DNA, 20 bp, synthetic construct
  source 1..20: mol_type = other DNA
gaagcctccaaggaagccat

SEQ ID NO: 28612 - DNA, 20 bp, synthetic construct
  source 1..20: mol_type = other DNA
gaagcctccaaggacacgga

SEQ ID NO: 28613 - DNA, 20 bp, synthetic construct
  source 1..20: mol_type = other DNA
cccgcctccaaggatactcc

SEQ ID NO: 28614 - DNA, 20 bp, synthetic construct
  source 1..20: mol_type = other DNA
cccgtggatctagagctgaa

SEQ ID NO: 28615 - DNA, 20 bp, synthetic construct
  source 1..20: mol_type = other DNA
cccgtggatctagatactcc

SEQ ID NO: 28616 - DNA, 20 bp, synthetic construct
  source 1..20: mol_type = other DNA
aattcctttatagacgtcaa

SEQ ID NO: 28617 - DNA, 20 bp, synthetic construct
  source 1..20: mol_type = other DNA
tggcaaaatctagattcttg

SEQ ID NO: 28618 - DNA, 20 bp, synthetic construct
  source 1..20: mol_type = other DNA
cgggtggatctagaccggcg

SEQ ID NO: 28619 - DNA, 20 bp, synthetic construct
  source 1..20: mol_type = other DNA
gccgtgtccctctcaccggc

SEQ ID NO: 28620 - DNA, 20 bp, synthetic construct
  source 1..20: mol_type = other DNA
gaatcgagaatctccacgga

SEQ ID NO: 28621 - DNA, 20 bp, synthetic construct
  source 1..20: mol_type = other DNA
cgggtgtccctctcccggcg

SEQ ID NO: 28622 - DNA, 20 bp, synthetic construct
  source 1..20: mol_type = other DNA
aattcctttatctccgtcaa

SEQ ID NO: 28623 - DNA, 20 bp, synthetic construct
  source 1..20: mol_type = other DNA
cgtaagtccctctccacgga

SEQ ID NO: 28624 - DNA, 20 bp, synthetic construct
  source 1..20: mol_type = other DNA
cgtaagtccctctcttcttg

SEQ ID NO: 28625 - DNA, 20 bp, synthetic construct
  source 1..20: mol_type = other DNA
cccaagtccctctctactcc

SEQ ID NO: 28626 - DNA, 20 bp, synthetic construct
  source 1..20: mol_type = other DNA
tggcaaaccctctcttcttg

SEQ ID NO: 28627 - DNA, 20 bp, synthetic construct
  source 1..20: mol_type = other DNA
gccgtgagacaggaaccggc

SEQ ID NO: 28628 - DNA, 20 bp, synthetic construct
  source 1..20: mol_type = other DNA
tggcaaagacaggattcttg

SEQ ID NO: 28629 - DNA, 20 bp, synthetic construct
  source 1..20: mol_type = other DNA
catgagagacaggattaata

SEQ ID NO: 28630 - DNA, 20 bp, synthetic construct
  source 1..20: mol_type = other DNA
gccgttcaacagaaaccggc

SEQ ID NO: 28631 - DNA, 20 bp, synthetic construct
  source 1..20: mol_type = other DNA
aattcctttaagaacgtcaa

SEQ ID NO: 28632 - DNA, 20 bp, synthetic construct
  source 1..20: mol_type = other DNA
gtagttcaacagaaagcttt

SEQ ID NO: 28633 - DNA, 20 bp, synthetic construct
  source 1..20: mol_type = other DNA
gtagttcaacagaaccggcg

SEQ ID NO: 28634 - DNA, 20 bp, synthetic construct
  source 1..20: mol_type = other DNA
cccgttcaacagaatactcc

SEQ ID NO: 28635 - DNA, 20 bp, synthetic construct
  source 1..20: mol_type = other DNA
gaatcgagaaagaacacgga

SEQ ID NO: 28636 - DNA, 20 bp, synthetic construct
  source 1..20: mol_type = other DNA
cgggttcaacagaaccggcg

SEQ ID NO: 28637 - DNA, 20 bp, synthetic construct
  source 1..20: mol_type = other DNA
tggcaaatccaagtttcttg

SEQ ID NO: 28638 - DNA, 20 bp, synthetic construct
  source 1..20: mol_type = other DNA
ttaacattccaagtttatct

SEQ ID NO: 28639 - DNA, 20 bp, synthetic construct
  source 1..20: mol_type = other DNA
taaatcaggtacagaatttc

SEQ ID NO: 28640 - DNA, 20 bp, synthetic construct
  source 1..20: mol_type = other DNA
cgggtcaggtacagccggcg

SEQ ID NO: 28641 - DNA, 20 bp, synthetic construct
  source 1..20: mol_type = other DNA
aattcctttaacagcgtcaa

SEQ ID NO: 28642 - DNA, 20 bp, synthetic construct
  source 1..20: mol_type = other DNA
aacagacaccatggtgcatc

SEQ ID NO: 28643 - DNA, 20 bp, synthetic construct
  source 1..20: mol_type = other DNA
aattcctttaatagcgtcaa

SEQ ID NO: 28644 - DNA, 20 bp, synthetic construct
  source 1..20: mol_type = other DNA
ttgttaccatatagcgtcaa

SEQ ID NO: 28645 - DNA, 20 bp, synthetic construct
  source 1..20: mol_type = other DNA
gccgtccacatgaaaccggc

SEQ ID NO: 28646 - DNA, 20 bp, synthetic construct
  source 1..20: mol_type = other DNA
cgccgccacatgaaaaagaa

SEQ ID NO: 28647 - DNA, 20 bp, synthetic construct
  source 1..20: mol_type = other DNA
cgccgccacatgaacgtcaa

SEQ ID NO: 28648 - DNA, 20 bp, synthetic construct
  source 1..20: mol_type = other DNA
aattcctttatgaacgtcaa

SEQ ID NO: 28649 - DNA, 20 bp, synthetic construct
  source 1..20: mol_type = other DNA
gaatcgagaacgaacacgga

SEQ ID NO: 28650 - DNA, 20 bp, synthetic construct
  source 1..20: mol_type = other DNA
cgggtatggccgaaccggcg

SEQ ID NO: 28651 - DNA, 20 bp, synthetic construct
  source 1..20: mol_type = other DNA
tagggatggccgaacgtcaa

SEQ ID NO: 28652 - DNA, 20 bp, synthetic construct
  source 1..20: mol_type = other DNA
aattcctttacgaacgtcaa

SEQ ID NO: 28653 - DNA, 20 bp, synthetic construct
  source 1..20: mol_type = other DNA
tggcaaaggccgaattcttg

SEQ ID NO: 28654 - DNA, 20 bp, synthetic construct
  source 1..20: mol_type = other DNA
gaatcgagaacccccacgga

SEQ ID NO: 28655 - DNA, 20 bp, synthetic construct
  source 1..20: mol_type = other DNA
gccgtcccttccccaccggc

SEQ ID NO: 28656 - DNA, 20 bp, synthetic construct
  source 1..20: mol_type = other DNA
aattcctttacccccgtcaa

SEQ ID NO: 28657 - DNA, 20 bp, synthetic construct
  source 1..20: mol_type = other DNA
tcccgcccttccccccggcg

SEQ ID NO: 28658 - DNA, 20 bp, synthetic construct
  source 1..20: mol_type = other DNA
tcccgcccttccccttcccg

SEQ ID NO: 28659 - DNA, 20 bp, synthetic construct
  source 1..20: mol_type = other DNA
ccccgcccttcccctactcc

SEQ ID NO: 28660 - DNA, 20 bp, synthetic construct
  source 1..20: mol_type = other DNA
tggcaaacttccccttcttg

SEQ ID NO: 28661 - DNA, 20 bp, synthetic construct
  source 1..20: mol_type = other DNA
cgggtcccttccccccggcg

SEQ ID NO: 28662 - DNA, 20 bp, synthetic construct
  source 1..20: mol_type = other DNA
gaatcgagaataaccacgga

SEQ ID NO: 28663 - DNA, 20 bp, synthetic construct
  source 1..20: mol_type = other DNA
cggtgtatcttaaccgtcaa

SEQ ID NO: 28664 - DNA, 20 bp, synthetic construct
  source 1..20: mol_type = other DNA
cggtgtatcttaacttcttg

SEQ ID NO: 28665 - DNA, 20 bp, synthetic construct
  source 1..20: mol_type = other DNA
tggcaaatcttaacttcttg

SEQ ID NO: 28666 - DNA, 20 bp, synthetic construct
  source 1..20: mol_type = other DNA
gccgtgcgttgcgtaccggc

SEQ ID NO: 28667 - DNA, 20 bp, synthetic construct
  source 1..20: mol_type = other DNA
gaatcgagaagcgtcacgga

SEQ ID NO: 28668 - DNA, 20 bp, synthetic construct
  source 1..20: mol_type = other DNA
cgggtgcgttgcgtccggcg

SEQ ID NO: 28669 - DNA, 20 bp, synthetic construct
  source 1..20: mol_type = other DNA
aattcctttagcgtcgtcaa

SEQ ID NO: 28670 - DNA, 20 bp, synthetic construct
  source 1..20: mol_type = other DNA
gccgtgcgttgcgtcgtcaa

SEQ ID NO: 28671 - DNA, 20 bp, synthetic construct
  source 1..20: mol_type = other DNA
gccgtgcgttgcgttactcc

SEQ ID NO: 28672 - DNA, 20 bp, synthetic construct
  source 1..20: mol_type = other DNA
gccgtgcgttgcgttccaag

SEQ ID NO: 28673 - DNA, 20 bp, synthetic construct
  source 1..20: mol_type = other DNA
gccgtgaatttttaaccggc

SEQ ID NO: 28674 - DNA, 20 bp, synthetic construct
  source 1..20: mol_type = other DNA
aattcctttatttacgtcaa

SEQ ID NO: 28675 - DNA, 20 bp, synthetic construct
  source 1..20: mol_type = other DNA
gtggagaatttttaaagaag

SEQ ID NO: 28676 - DNA, 20 bp, synthetic construct
  source 1..20: mol_type = other DNA
gtggagaatttttaccggcg

SEQ ID NO: 28677 - DNA, 20 bp, synthetic construct
  source 1..20: mol_type = other DNA
tggcaaaatttttattcttg

SEQ ID NO: 28678 - DNA, 20 bp, synthetic construct
  source 1..20: mol_type = other DNA
gaatcgagaaccaacacgga

SEQ ID NO: 28679 - DNA, 20 bp, synthetic construct
  source 1..20: mol_type = other DNA
cgggtgctgaccaaccggcg

SEQ ID NO: 28680 - DNA, 20 bp, synthetic construct
  source 1..20: mol_type = other DNA
ccaaagctgaccaacgtcaa

SEQ ID NO: 28681 - DNA, 20 bp, synthetic construct
  source 1..20: mol_type = other DNA
cccaagctgaccaatactcc

SEQ ID NO: 28682 - DNA, 20 bp, synthetic construct
  source 1..20: mol_type = other DNA
tggcaaatgaccaattcttg

SEQ ID NO: 28683 - DNA, 20 bp, synthetic construct
  source 1..20: mol_type = other DNA
gctccactcctggtggtgcc

SEQ ID NO: 28684 - DNA, 20 bp, synthetic construct
  source 1..20: mol_type = other DNA
gacggtatctgatcgtcttc

SEQ ID NO: 28685 - DNA, 20 bp, synthetic construct
  source 1..20: mol_type = other DNA
tacagacaccatggtgcatc

SEQ ID NO: 28686 - DNA, 20 bp, synthetic construct
  source 1..20: mol_type = other DNA
gccgtacaccatggaccggc

SEQ ID NO: 28687 - DNA, 20 bp, synthetic construct
  source 1..20: mol_type = other DNA
gccgtacaccatggtgcatc

SEQ ID NO: 28688 - DNA, 20 bp, synthetic construct
  source 1..20: mol_type = other DNA
gaatcgagaaatggcacgga

SEQ ID NO: 28689 - DNA, 20 bp, synthetic construct
  source 1..20: mol_type = other DNA
gaatcgagaaatggtgcatc

SEQ ID NO: 28690 - DNA, 20 bp, synthetic construct
  source 1..20: mol_type = other DNA
agcgagcgaccaaaggaacc

SEQ ID NO: 28691 - DNA, 20 bp, synthetic construct
  source 1..20: mol_type = other DNA
gcgggtcaccatggtgcatc

SEQ ID NO: 28692 - DNA, 20 bp, synthetic construct
  source 1..20: mol_type = other DNA
cgggtacaccatggccggcg

SEQ ID NO: 28693 - DNA, 20 bp, synthetic construct
  source 1..20: mol_type = other DNA
cgggtacaccatggtgcatc

SEQ ID NO: 28694 - DNA, 20 bp, synthetic construct
  source 1..20: mol_type = other DNA
caattcctttatggtgcatc

SEQ ID NO: 28695 - DNA, 20 bp, synthetic construct
  source 1..20: mol_type = other DNA
aattcctttaatggcgtcaa

SEQ ID NO: 28696 - DNA, 20 bp, synthetic construct
  source 1..20: mol_type = other DNA
aattcctttaatggtgcatc

SEQ ID NO: 28697 - DNA, 20 bp, synthetic construct
  source 1..20: mol_type = other DNA
aacaaccggccgtgtgcatc

SEQ ID NO: 28698 - DNA, 20 bp, synthetic construct
  source 1..20: mol_type = other DNA
aacaagcgaccaaaggaacc

SEQ ID NO: 28699 - DNA, 20 bp, synthetic construct
  source 1..20: mol_type = other DNA
aacacacggaatcgagaatc

SEQ ID NO: 28700 - DNA, 20 bp, synthetic construct
  source 1..20: mol_type = other DNA
aacacactcctggtggtgcc

SEQ ID NO: 28701 - DNA, 20 bp, synthetic construct
  source 1..20: mol_type = other DNA
aacacgtgttgagtcaaatt

SEQ ID NO: 28702 - DNA, 20 bp, synthetic construct
  source 1..20: mol_type = other DNA
aacagaaccggccgtgcatc

SEQ ID NO: 28703 - DNA, 20 bp, synthetic construct
  source 1..20: mol_type = other DNA
aacagacaaccaaaggaacc

SEQ ID NO: 28704 - DNA, 20 bp, synthetic construct
  source 1..20: mol_type = other DNA
aacagacacaccatactccc

SEQ ID NO: 28705 - DNA, 20 bp, synthetic construct
  source 1..20: mol_type = other DNA
aacagacacacggaatcgag

SEQ ID NO: 28706 - DNA, 20 bp, synthetic construct
  source 1..20: mol_type = other DNA
aacagacaccaatcgtcttc

SEQ ID NO: 28707 - DNA, 20 bp, synthetic construct
  source 1..20: mol_type = other DNA
aacagacaccacacggaatc

SEQ ID NO: 28708 - DNA, 20 bp, synthetic construct
  source 1..20: mol_type = other DNA
aacagacaccacatactccc

SEQ ID NO: 28709 - DNA, 20 bp, synthetic construct
  source 1..20: mol_type = other DNA
aacagacaccaccggcgggt

SEQ ID NO: 28710 - DNA, 20 bp, synthetic construct
  source 1..20: mol_type = other DNA
aacagacaccaggtggtgcc

SEQ ID NO: 28711 - DNA, 20 bp, synthetic construct
  source 1..20: mol_type = other DNA
aacagacaccatgaccggcc

SEQ ID NO: 28712 - DNA, 20 bp, synthetic construct
  source 1..20: mol_type = other DNA
aacagacaccatgaggaacc

SEQ ID NO: 28713 - DNA, 20 bp, synthetic construct
  source 1..20: mol_type = other DNA
aacagacaccatgcgtcaat

SEQ ID NO: 28714 - DNA, 20 bp, synthetic construct
  source 1..20: mol_type = other DNA
aacagacaccatggaccggc

SEQ ID NO: 28715 - DNA, 20 bp, synthetic construct
  source 1..20: mol_type = other DNA
aacagacaccatggcacgga

SEQ ID NO: 28716 - DNA, 20 bp, synthetic construct
  source 1..20: mol_type = other DNA
aacagacaccatggccggcg

SEQ ID NO: 28717 - DNA, 20 bp, synthetic construct
  source 1..20: mol_type = other DNA
aacagacaccatggcgtcaa

SEQ ID NO: 28718 - DNA, 20 bp, synthetic construct
  source 1..20: mol_type = other DNA
aacagacaccatggggaacc

SEQ ID NO: 28719 - DNA, 20 bp, synthetic construct
  source 1..20: mol_type = other DNA
aacagacaccatggggtgcc

SEQ ID NO: 28720 - DNA, 20 bp, synthetic construct
  source 1..20: mol_type = other DNA
aacagacaccatggtaaatt

SEQ ID NO: 28721 - DNA, 20 bp, synthetic construct
  source 1..20: mol_type = other DNA
aacagacaccatggtactcc

SEQ ID NO: 28722 - DNA, 20 bp, synthetic construct
  source 1..20: mol_type = other DNA
aacagacaccatggtatcgc

SEQ ID NO: 28723 - DNA, 20 bp, synthetic construct
  source 1..20: mol_type = other DNA
aacagacaccatggtcacgg

SEQ ID NO: 28724 - DNA, 20 bp, synthetic construct
  source 1..20: mol_type = other DNA
aacagacaccatggtcgtca

SEQ ID NO: 28725 - DNA, 20 bp, synthetic construct
  source 1..20: mol_type = other DNA
aacagacaccatggtgcaca

SEQ ID NO: 28726 - DNA, 20 bp, synthetic construct
  source 1..20: mol_type = other DNA
aacagacaccatggtgcacg

SEQ ID NO: 28727 - DNA, 20 bp, synthetic construct
  source 1..20: mol_type = other DNA
aacagacaccatggtgcatt

SEQ ID NO: 28728 - DNA, 20 bp, synthetic construct
  source 1..20: mol_type = other DNA
aacagacaccatggtgcgcc

SEQ ID NO: 28729 - DNA, 20 bp, synthetic construct
  source 1..20: mol_type = other DNA
aacagacaccatggtgtgcc

SEQ ID NO: 28730 - DNA, 20 bp, synthetic construct
  source 1..20: mol_type = other DNA
aacagacaccatggtgttct

SEQ ID NO: 28731 - DNA, 20 bp, synthetic construct
  source 1..20: mol_type = other DNA
aacagacaccatggttcttg

SEQ ID NO: 28732 - DNA, 20 bp, synthetic construct
  source 1..20: mol_type = other DNA
aacagacaccatgtactccc

SEQ ID NO: 28733 - DNA, 20 bp, synthetic construct
  source 1..20: mol_type = other DNA
aacagacaccatgtcaaatt

SEQ ID NO: 28734 - DNA, 20 bp, synthetic construct
  source 1..20: mol_type = other DNA
aacagacaccatgtggtgcc

SEQ ID NO: 28735 - DNA, 20 bp, synthetic construct
  source 1..20: mol_type = other DNA
aacagacacgtcaattcctt

SEQ ID NO: 28736 - DNA, 20 bp, synthetic construct
  source 1..20: mol_type = other DNA
aacagacacttcttggcaaa

SEQ ID NO: 28737 - DNA, 20 bp, synthetic construct
  source 1..20: mol_type = other DNA
aacagacatactcccgcatc

SEQ ID NO: 28738 - DNA, 20 bp, synthetic construct
  source 1..20: mol_type = other DNA
aacagaccaaccatactccc

SEQ ID NO: 28739 - DNA, 20 bp, synthetic construct
  source 1..20: mol_type = other DNA
aacagaccggcgggtgcatc

SEQ ID NO: 28740 - DNA, 20 bp, synthetic construct
  source 1..20: mol_type = other DNA
aacagacgtcaattccttta

SEQ ID NO: 28741 - DNA, 20 bp, synthetic construct
  source 1..20: mol_type = other DNA
aacagacgttgagtcaaatt

SEQ ID NO: 28742 - DNA, 20 bp, synthetic construct
  source 1..20: mol_type = other DNA
aacagagcaaccatactccc

SEQ ID NO: 28743 - DNA, 20 bp, synthetic construct
  source 1..20: mol_type = other DNA
aacaggcgaccaaaggaacc

SEQ ID NO: 28744 - DNA, 20 bp, synthetic construct
  source 1..20: mol_type = other DNA
aacattcttggcaaagcatc

SEQ ID NO: 28745 - DNA, 20 bp, synthetic construct
  source 1..20: mol_type = other DNA
aacccgtgttgagtcaaatt

SEQ ID NO: 28746 - DNA, 20 bp, synthetic construct
  source 1..20: mol_type = other DNA
aacgagcgaccaaaggaacc

SEQ ID NO: 28747 - DNA, 20 bp, synthetic construct
  source 1..20: mol_type = other DNA
aacggtatctgatcgtcttc

SEQ ID NO: 28748 - DNA, 20 bp, synthetic construct
  source 1..20: mol_type = other DNA
acacggaatcgagaagcatc

SEQ ID NO: 28749 - DNA, 20 bp, synthetic construct
  source 1..20: mol_type = other DNA
acgtcaattcctttagcatc

SEQ ID NO: 28750 - DNA, 20 bp, synthetic construct
  source 1..20: mol_type = other DNA
agctttgcaaccatactccc

SEQ ID NO: 28751 - DNA, 20 bp, synthetic construct
  source 1..20: mol_type = other DNA
atactcccccatggtgcatc

SEQ ID NO: 28752 - DNA, 20 bp, synthetic construct
  source 1..20: mol_type = other DNA
atcccgtgttgagtcaaatt

SEQ ID NO: 28753 - DNA, 20 bp, synthetic construct
  source 1..20: mol_type = other DNA
ccggccgtccatggtgcatc

SEQ ID NO: 28754 - DNA, 20 bp, synthetic construct
  source 1..20: mol_type = other DNA
ttcttggcaaatggtgcatc

SEQ ID NO: 28755 - DNA, 20 bp, synthetic construct
  source 1..20: mol_type = other DNA
cggcgggtccatggtgcatc

SEQ ID NO: 28756 - DNA, 20 bp, synthetic construct
  source 1..20: mol_type = other DNA
gaattaaccagacaaatcgc

SEQ ID NO: 28757 - DNA, 20 bp, synthetic construct
  source 1..20: mol_type = other DNA
ttggcaaaccatggtgcatc

SEQ ID NO: 28758 - DNA, 20 bp, synthetic construct
  source 1..20: mol_type = other DNA
cccagacaccatggtactcc

SEQ ID NO: 28759 - DNA, 20 bp, synthetic construct
  source 1..20: mol_type = other DNA
cccagacaccatggtgcatc

SEQ ID NO: 28760 - DNA, 20 bp, synthetic construct
  source 1..20: mol_type = other DNA
tggcaaaaccatggtgcatc

SEQ ID NO: 28761 - DNA, 20 bp, synthetic construct
  source 1..20: mol_type = other DNA
tggcaaaaccatggttcttg

SEQ ID NO: 28762 - DNA, 20 bp, synthetic construct
  source 1..20: mol_type = other DNA
ggcaaacaccatggtgcatc

SEQ ID NO: 28763 - DNA, 20 bp, synthetic construct
  source 1..20: mol_type = other DNA
atcgagaaccatggtgcatc

SEQ ID NO: 28764 - DNA, 20 bp, synthetic construct
  source 1..20: mol_type = other DNA
ttcctttaccatggtgcatc

SEQ ID NO: 28765 - DNA, 20 bp, synthetic construct
  source 1..20: mol_type = other DNA
cacagacaccatggtgcatc

SEQ ID NO: 28766 - DNA, 20 bp, synthetic construct
  source 1..20: mol_type = other DNA
gccgtagtctggggaccggc

SEQ ID NO: 28767 - DNA, 20 bp, synthetic construct
  source 1..20: mol_type = other DNA
tcctcagtctgcggcacgga

SEQ ID NO: 28768 - DNA, 20 bp, synthetic construct
  source 1..20: mol_type = other DNA
tcctcagtctgcggcgtcaa

SEQ ID NO: 28769 - DNA, 20 bp, synthetic construct
  source 1..20: mol_type = other DNA
tcctcagtctgcggtactcc

SEQ ID NO: 28770 - DNA, 20 bp, synthetic construct
  source 1..20: mol_type = other DNA
tcctcagtctgcggtgggct

SEQ ID NO: 28771 - DNA, 20 bp, synthetic construct
  source 1..20: mol_type = other DNA
tcctcagtctgcggttcttg

SEQ ID NO: 28772 - DNA, 20 bp, synthetic construct
  source 1..20: mol_type = other DNA
ccctcagtctgcggtactcc

SEQ ID NO: 28773 - DNA, 20 bp, synthetic construct
  source 1..20: mol_type = other DNA
tggcaaatctgcggttcttg

SEQ ID NO: 28774 - DNA, 20 bp, synthetic construct
  source 1..20: mol_type = other DNA
cgggtggaagaaaaccggcg

SEQ ID NO: 28775 - DNA, 20 bp, synthetic construct
  source 1..20: mol_type = other DNA
aaaagggaagaaaatactcc

SEQ ID NO: 28776 - DNA, 20 bp, synthetic construct
  source 1..20: mol_type = other DNA
aaaagggaagaaaattcttg

SEQ ID NO: 28777 - DNA, 20 bp, synthetic construct
  source 1..20: mol_type = other DNA
gaatcgagaaaaaacacgga

SEQ ID NO: 28778 - DNA, 20 bp, synthetic construct
  source 1..20: mol_type = other DNA
tggcaaaaagaaaattcttg

SEQ ID NO: 28779 - DNA, 20 bp, synthetic construct
  source 1..20: mol_type = other DNA
gaatcgagaaaactcacgga

SEQ ID NO: 28780 - DNA, 20 bp, synthetic construct
  source 1..20: mol_type = other DNA
cgggtaatcaaactccggcg

SEQ ID NO: 28781 - DNA, 20 bp, synthetic construct
  source 1..20: mol_type = other DNA
aattcctttaaactcgtcaa

SEQ ID NO: 28782 - DNA, 20 bp, synthetic construct
  source 1..20: mol_type = other DNA
gccgtaatcaaactaccggc

SEQ ID NO: 28783 - DNA, 20 bp, synthetic construct
  source 1..20: mol_type = other DNA
agacaaatcaaactccggcg

SEQ ID NO: 28784 - DNA, 20 bp, synthetic construct
  source 1..20: mol_type = other DNA
agacaaatcaaactcgtcaa

SEQ ID NO: 28785 - DNA, 20 bp, synthetic construct
  source 1..20: mol_type = other DNA
agacaaatcaaacttactcc

SEQ ID NO: 28786 - DNA, 20 bp, synthetic construct
  source 1..20: mol_type = other DNA
tggcaaatcaaactttcttg

SEQ ID NO: 28787 - DNA, 20 bp, synthetic construct
  source 1..20: mol_type = other DNA
gaatcgagaaccctcacgga

SEQ ID NO: 28788 - DNA, 20 bp, synthetic construct
  source 1..20: mol_type = other DNA
cgggtcggttccctccggcg

SEQ ID NO: 28789 - DNA, 20 bp, synthetic construct
  source 1..20: mol_type = other DNA
gtaaccggttccctcacgga

SEQ ID NO: 28790 - DNA, 20 bp, synthetic construct
  source 1..20: mol_type = other DNA
cccaccggttcccttactcc

SEQ ID NO: 28791 - DNA, 20 bp, synthetic construct
  source 1..20: mol_type = other DNA
gccgtcggttccctaccggc

SEQ ID NO: 28792 - DNA, 20 bp, synthetic construct
  source 1..20: mol_type = other DNA
gaatcgagaattcccacgga

SEQ ID NO: 28793 - DNA, 20 bp, synthetic construct
  source 1..20: mol_type = other DNA
gccgtgctgcttccaccggc

SEQ ID NO: 28794 - DNA, 20 bp, synthetic construct
  source 1..20: mol_type = other DNA
gagcggctgcttcccgtcaa

SEQ ID NO: 28795 - DNA, 20 bp, synthetic construct
  source 1..20: mol_type = other DNA
gagcggctgcttcctactcc

SEQ ID NO: 28796 - DNA, 20 bp, synthetic construct
  source 1..20: mol_type = other DNA
ccccggctgcttcctactcc

SEQ ID NO: 28797 - DNA, 20 bp, synthetic construct
  source 1..20: mol_type = other DNA
tggcaaatgcttccttcttg

SEQ ID NO: 28798 - DNA, 20 bp, synthetic construct
  source 1..20: mol_type = other DNA
gccgtcggtccacgaccggc

SEQ ID NO: 28799 - DNA, 20 bp, synthetic construct
  source 1..20: mol_type = other DNA
acgtacggtccacgtactcc

SEQ ID NO: 28800 - DNA, 20 bp, synthetic construct
  source 1..20: mol_type = other DNA
ccctacggtccacgtactcc

SEQ ID NO: 28801 - DNA, 20 bp, synthetic construct
  source 1..20: mol_type = other DNA
tggcaaagtccacgttcttg

SEQ ID NO: 28802 - DNA, 20 bp, synthetic construct
  source 1..20: mol_type = other DNA
catcggcatgccgcaccggc

SEQ ID NO: 28803 - DNA, 20 bp, synthetic construct
  source 1..20: mol_type = other DNA
catcggcatgccgctactcc

SEQ ID NO: 28804 - DNA, 20 bp, synthetic construct
  source 1..20: mol_type = other DNA
cgggtgcatgccgcccggcg

SEQ ID NO: 28805 - DNA, 20 bp, synthetic construct
  source 1..20: mol_type = other DNA
aattcctttaccgccgtcaa

SEQ ID NO: 28806 - DNA, 20 bp, synthetic construct
  source 1..20: mol_type = other DNA
ccccggcatgccgctactcc

SEQ ID NO: 28807 - DNA, 20 bp, synthetic construct
  source 1..20: mol_type = other DNA
gccgtggcgggggaaccggc

SEQ ID NO: 28808 - DNA, 20 bp, synthetic construct
  source 1..20: mol_type = other DNA
gaatcgagaagggacacgga

SEQ ID NO: 28809 - DNA, 20 bp, synthetic construct
  source 1..20: mol_type = other DNA
cccacggcgggggatactcc

SEQ ID NO: 28810 - DNA, 20 bp, synthetic construct
  source 1..20: mol_type = other DNA
aaattaaccagacaaatcgc

SEQ ID NO: 28811 - DNA, 20 bp, synthetic construct
  source 1..20: mol_type = other DNA
actccactcctggtggtgcc

SEQ ID NO: 28812 - DNA, 20 bp, synthetic construct
  source 1..20: mol_type = other DNA
ataacggcaaccatactccc

SEQ ID NO: 28813 - DNA, 20 bp, synthetic construct
  source 1..20: mol_type = other DNA
ataacggcaccaaaggaacc

SEQ ID NO: 28814 - DNA, 20 bp, synthetic construct
  source 1..20: mol_type = other DNA
ataacggcgaccatactccc

SEQ ID NO: 28815 - DNA, 20 bp, synthetic construct
  source 1..20: mol_type = other DNA
ataacggcgggaaaggaacc

SEQ ID NO: 28816 - DNA, 20 bp, synthetic construct
  source 1..20: mol_type = other DNA
ataacggcgggacaaatcgc

SEQ ID NO: 28817 - DNA, 20 bp, synthetic construct
  source 1..20: mol_type = other DNA
ataacggcgggcatactccc

SEQ ID NO: 28818 - DNA, 20 bp, synthetic construct
  source 1..20: mol_type = other DNA
ataacggcggggaaggaacc

SEQ ID NO: 28819 - DNA, 20 bp, synthetic construct
  source 1..20: mol_type = other DNA
ataacggcggggcaaatcgc

SEQ ID NO: 28820 - DNA, 20 bp, synthetic construct
  source 1..20: mol_type = other DNA
ataacggcgggggaactccc

SEQ ID NO: 28821 - DNA, 20 bp, synthetic construct
  source 1..20: mol_type = other DNA
ataacggcgggggacaaatt

SEQ ID NO: 28822 - DNA, 20 bp, synthetic construct
  source 1..20: mol_type = other DNA
ataacggcgggggaccggcg

SEQ ID NO: 28823 - DNA, 20 bp, synthetic construct
  source 1..20: mol_type = other DNA
ataacggcgggggagatcgc

SEQ ID NO: 28824 - DNA, 20 bp, synthetic construct
  source 1..20: mol_type = other DNA
ataacggcgggggaggccgc

SEQ ID NO: 28825 - DNA, 20 bp, synthetic construct
  source 1..20: mol_type = other DNA
ataacggcgggggaggccgt

SEQ ID NO: 28826 - DNA, 20 bp, synthetic construct
  source 1..20: mol_type = other DNA
ataacggcgggggaggcgcc

SEQ ID NO: 28827 - DNA, 20 bp, synthetic construct
  source 1..20: mol_type = other DNA
ataacggcgggggaggcttc

SEQ ID NO: 28828 - DNA, 20 bp, synthetic construct
  source 1..20: mol_type = other DNA
ataacggcgggggtggtgcc

SEQ ID NO: 28829 - DNA, 20 bp, synthetic construct
  source 1..20: mol_type = other DNA
ataacggcgtgagtcaaatt

SEQ ID NO: 28830 - DNA, 20 bp, synthetic construct
  source 1..20: mol_type = other DNA
ataacgggaccaaaggaacc

SEQ ID NO: 28831 - DNA, 20 bp, synthetic construct
  source 1..20: mol_type = other DNA
ataacgtgttgagtcaaatt

SEQ ID NO: 28832 - DNA, 20 bp, synthetic construct
  source 1..20: mol_type = other DNA
ataactgcaaccatactccc

SEQ ID NO: 28833 - DNA, 20 bp, synthetic construct
  source 1..20: mol_type = other DNA
ataccactcctggtggtgcc

SEQ ID NO: 28834 - DNA, 20 bp, synthetic construct
  source 1..20: mol_type = other DNA
ataccgtgttgagtcaaatt

SEQ ID NO: 28835 - DNA, 20 bp, synthetic construct
  source 1..20: mol_type = other DNA
atagagcgaccaaaggaacc

SEQ ID NO: 28836 - DNA, 20 bp, synthetic construct
  source 1..20: mol_type = other DNA
atcgagcgaccaaaggaacc

SEQ ID NO: 28837 - DNA, 20 bp, synthetic construct
  source 1..20: mol_type = other DNA
aattcctttagggacgtcaa

SEQ ID NO: 28838 - DNA, 20 bp, synthetic construct
  source 1..20: mol_type = other DNA
ggctttgcaaccatactccc

SEQ ID NO: 28839 - DNA, 20 bp, synthetic construct
  source 1..20: mol_type = other DNA
gtcgagcgaccaaaggaacc

SEQ ID NO: 28840 - DNA, 20 bp, synthetic construct
  source 1..20: mol_type = other DNA
gtctttgcaaccatactccc

SEQ ID NO: 28841 - DNA, 20 bp, synthetic construct
  source 1..20: mol_type = other DNA
gtgccactcctggtggtgcc

SEQ ID NO: 28842 - DNA, 20 bp, synthetic construct
  source 1..20: mol_type = other DNA
gtgccgtgttgagtcaaatt

SEQ ID NO: 28843 - DNA, 20 bp, synthetic construct
  source 1..20: mol_type = other DNA
gtgttaaccagacaaatcgc

SEQ ID NO: 28844 - DNA, 20 bp, synthetic construct
  source 1..20: mol_type = other DNA
gtgttaatctgatcgtcttc

SEQ ID NO: 28845 - DNA, 20 bp, synthetic construct
  source 1..20: mol_type = other DNA
gtgttacgaccaaaggaacc

SEQ ID NO: 28846 - DNA, 20 bp, synthetic construct
  source 1..20: mol_type = other DNA
gtgttagcaaccatactccc

SEQ ID NO: 28847 - DNA, 20 bp, synthetic construct
  source 1..20: mol_type = other DNA
gtgttagtcagacaaatcgc

SEQ ID NO: 28848 - DNA, 20 bp, synthetic construct
  source 1..20: mol_type = other DNA
gtgttagtcctggtggtgcc

SEQ ID NO: 28849 - DNA, 20 bp, synthetic construct
  source 1..20: mol_type = other DNA
gtgttagttagacaaatcgc

SEQ ID NO: 28850 - DNA, 20 bp, synthetic construct
  source 1..20: mol_type = other DNA
gtgttagttgcaaaggaacc

SEQ ID NO: 28851 - DNA, 20 bp, synthetic construct
  source 1..20: mol_type = other DNA
gtgttagttggacaaatcgc

SEQ ID NO: 28852 - DNA, 20 bp, synthetic construct
  source 1..20: mol_type = other DNA
gtgttagttgtgatactccc

SEQ ID NO: 28853 - DNA, 20 bp, synthetic construct
  source 1..20: mol_type = other DNA
gtgttagttgtggtggtgcc

SEQ ID NO: 28854 - DNA, 20 bp, synthetic construct
  source 1..20: mol_type = other DNA
gtgttagttgtgtaggaacc

SEQ ID NO: 28855 - DNA, 20 bp, synthetic construct
  source 1..20: mol_type = other DNA
gtgttagttgtgtcgtcttc

SEQ ID NO: 28856 - DNA, 20 bp, synthetic construct
  source 1..20: mol_type = other DNA
gtgttagttgtgttaatcgc

SEQ ID NO: 28857 - DNA, 20 bp, synthetic construct
  source 1..20: mol_type = other DNA
gtgttagttgtgttaccggc

SEQ ID NO: 28858 - DNA, 20 bp, synthetic construct
  source 1..20: mol_type = other DNA
gtgttagttgtgttagaacc

SEQ ID NO: 28859 - DNA, 20 bp, synthetic construct
  source 1..20: mol_type = other DNA
gtgttagttgtgttagtatt

SEQ ID NO: 28860 - DNA, 20 bp, synthetic construct
  source 1..20: mol_type = other DNA
gtgttagttgtgttagtccc

SEQ ID NO: 28861 - DNA, 20 bp, synthetic construct
  source 1..20: mol_type = other DNA
gtgttagttgtgttagtgcc

SEQ ID NO: 28862 - DNA, 20 bp, synthetic construct
  source 1..20: mol_type = other DNA
gtgttagttgtgttagttcc

SEQ ID NO: 28863 - DNA, 20 bp, synthetic construct
  source 1..20: mol_type = other DNA
gtgttagttgtgttagttgc

SEQ ID NO: 28864 - DNA, 20 bp, synthetic construct
  source 1..20: mol_type = other DNA
gtgttagttgtgttagttgt

SEQ ID NO: 28865 - DNA, 20 bp, synthetic construct
  source 1..20: mol_type = other DNA
gtgttagttgtgttatcttc

SEQ ID NO: 28866 - DNA, 20 bp, synthetic construct
  source 1..20: mol_type = other DNA
gtgttagttgtgttcaaatt

SEQ ID NO: 28867 - DNA, 20 bp, synthetic construct
  source 1..20: mol_type = other DNA
gtgttagttgtgttccggcg

SEQ ID NO: 28868 - DNA, 20 bp, synthetic construct
  source 1..20: mol_type = other DNA
gtgttagttgtgttggtgcc

SEQ ID NO: 28869 - DNA, 20 bp, synthetic construct
  source 1..20: mol_type = other DNA
gtgttagtttgatcgtcttc

SEQ ID NO: 28870 - DNA, 20 bp, synthetic construct
  source 1..20: mol_type = other DNA
gtgtttatctgatcgtcttc

SEQ ID NO: 28871 - DNA, 20 bp, synthetic construct
  source 1..20: mol_type = other DNA
gaatcgagaatgttcacgga

SEQ ID NO: 28872 - DNA, 20 bp, synthetic construct
  source 1..20: mol_type = other DNA
cccttagttgtgtttactcc

SEQ ID NO: 28873 - DNA, 20 bp, synthetic construct
  source 1..20: mol_type = other DNA
aattcctttatgttcgtcaa

SEQ ID NO: 28874 - DNA, 20 bp, synthetic construct
  source 1..20: mol_type = other DNA
gacatttctgacatttctga

SEQ ID NO: 28875 - DNA, 20 bp, synthetic construct
  source 1..20: mol_type = other DNA
cactatctgctagaccggcg

SEQ ID NO: 28876 - DNA, 20 bp, synthetic construct
  source 1..20: mol_type = other DNA
gaatcgagaatagacacgga

SEQ ID NO: 28877 - DNA, 20 bp, synthetic construct
  source 1..20: mol_type = other DNA
gccgttgctgtggaaccggc

SEQ ID NO: 28878 - DNA, 20 bp, synthetic construct
  source 1..20: mol_type = other DNA
gaatcgagaatggacacgga

SEQ ID NO: 28879 - DNA, 20 bp, synthetic construct
  source 1..20: mol_type = other DNA
cgggttgctgtggaccggcg

SEQ ID NO: 28880 - DNA, 20 bp, synthetic construct
  source 1..20: mol_type = other DNA
ccaagtgctgtggacgtcaa

SEQ ID NO: 28881 - DNA, 20 bp, synthetic construct
  source 1..20: mol_type = other DNA
ccaagtgctgtggactggcc

SEQ ID NO: 28882 - DNA, 20 bp, synthetic construct
  source 1..20: mol_type = other DNA
ccaagtgctgtggattcttg

SEQ ID NO: 28883 - DNA, 20 bp, synthetic construct
  source 1..20: mol_type = other DNA
gccgtttctgacataccggc

SEQ ID NO: 28884 - DNA, 20 bp, synthetic construct
  source 1..20: mol_type = other DNA
gaatcgagaaacatcacgga

SEQ ID NO: 28885 - DNA, 20 bp, synthetic construct
  source 1..20: mol_type = other DNA
gaatcgagaaacatttctga

SEQ ID NO: 28886 - DNA, 20 bp, synthetic construct
  source 1..20: mol_type = other DNA
gacatttctgacatcacgga

SEQ ID NO: 28887 - DNA, 20 bp, synthetic construct
  source 1..20: mol_type = other DNA
cgggtttctgacatccggcg

SEQ ID NO: 28888 - DNA, 20 bp, synthetic construct
  source 1..20: mol_type = other DNA
aattcctttaacatcgtcaa

SEQ ID NO: 28889 - DNA, 20 bp, synthetic construct
  source 1..20: mol_type = other DNA
aattcctttaacatttctga

SEQ ID NO: 28890 - DNA, 20 bp, synthetic construct
  source 1..20: mol_type = other DNA
gacatttctgacatcgtcaa

SEQ ID NO: 28891 - DNA, 20 bp, synthetic construct
  source 1..20: mol_type = other DNA
cccatttctgacattactcc

SEQ ID NO: 28892 - DNA, 20 bp, synthetic construct
  source 1..20: mol_type = other DNA
aacatttctgacatttctga

SEQ ID NO: 28893 - DNA, 20 bp, synthetic construct
  source 1..20: mol_type = other DNA
agaatttctgacatttctga

SEQ ID NO: 28894 - DNA, 20 bp, synthetic construct
  source 1..20: mol_type = other DNA
tttatttctgacatttctga

SEQ ID NO: 28895 - DNA, 20 bp, synthetic construct
  source 1..20: mol_type = other DNA
ccgttttctgacatttctga

SEQ ID NO: 28896 - DNA, 20 bp, synthetic construct
  source 1..20: mol_type = other DNA
gggttttctgacatttctga

SEQ ID NO: 28897 - DNA, 20 bp, synthetic construct
  source 1..20: mol_type = other DNA
gccgtttctgacatttctga

SEQ ID NO: 28898 - DNA, 20 bp, synthetic construct
  source 1..20: mol_type = other DNA
cgggtttctgacatttctga

SEQ ID NO: 28899 - DNA, 20 bp, synthetic construct
  source 1..20: mol_type = other DNA
ggccgttctgacatttctga

SEQ ID NO: 28900 - DNA, 20 bp, synthetic construct
  source 1..20: mol_type = other DNA
cccatttctgacatttctga

SEQ ID NO: 28901 - DNA, 20 bp, synthetic construct
  source 1..20: mol_type = other DNA
gcgggttctgacatttctga

SEQ ID NO: 28902 - DNA, 20 bp, synthetic construct
  source 1..20: mol_type = other DNA
caattcctttacatttctga

SEQ ID NO: 28903 - DNA, 20 bp, synthetic construct
  source 1..20: mol_type = other DNA
ggcaaatctgacatttctga

SEQ ID NO: 28904 - DNA, 20 bp, synthetic construct
  source 1..20: mol_type = other DNA
ccggccgttgacatttctga

SEQ ID NO: 28905 - DNA, 20 bp, synthetic construct
  source 1..20: mol_type = other DNA
cggcgggttgacatttctga

SEQ ID NO: 28906 - DNA, 20 bp, synthetic construct
  source 1..20: mol_type = other DNA
gacaaccggccgttttctga

SEQ ID NO: 28907 - DNA, 20 bp, synthetic construct
  source 1..20: mol_type = other DNA
gacacgtcaattcctttaga

SEQ ID NO: 28908 - DNA, 20 bp, synthetic construct
  source 1..20: mol_type = other DNA
gacatactcctggtggtgcc

SEQ ID NO: 28909 - DNA, 20 bp, synthetic construct
  source 1..20: mol_type = other DNA
gacatgcgaccaaaggaacc

SEQ ID NO: 28910 - DNA, 20 bp, synthetic construct
  source 1..20: mol_type = other DNA
gacattaccagacaaatcgc

SEQ ID NO: 28911 - DNA, 20 bp, synthetic construct
  source 1..20: mol_type = other DNA
gacattaccggccgttctga

SEQ ID NO: 28912 - DNA, 20 bp, synthetic construct
  source 1..20: mol_type = other DNA
gacattcacggaatcgagaa

SEQ ID NO: 28913 - DNA, 20 bp, synthetic construct
  source 1..20: mol_type = other DNA
gacattccggcgggttctga

SEQ ID NO: 28914 - DNA, 20 bp, synthetic construct
  source 1..20: mol_type = other DNA
gacattcgtcaattccttta

SEQ ID NO: 28915 - DNA, 20 bp, synthetic construct
  source 1..20: mol_type = other DNA
gacattcttggcaaatctga

SEQ ID NO: 28916 - DNA, 20 bp, synthetic construct
  source 1..20: mol_type = other DNA
gacatttactccctttctga

SEQ ID NO: 28917 - DNA, 20 bp, synthetic construct
  source 1..20: mol_type = other DNA
gacatttccgtcaattcctt

SEQ ID NO: 28918 - DNA, 20 bp, synthetic construct
  source 1..20: mol_type = other DNA
gacatttctagacaaatcgc

SEQ ID NO: 28919 - DNA, 20 bp, synthetic construct
  source 1..20: mol_type = other DNA
gacatttctccaaaggaacc

SEQ ID NO: 28920 - DNA, 20 bp, synthetic construct
  source 1..20: mol_type = other DNA
gacatttctccggcgggtga

SEQ ID NO: 28921 - DNA, 20 bp, synthetic construct
  source 1..20: mol_type = other DNA
gacatttctgaaccggccgt

SEQ ID NO: 28922 - DNA, 20 bp, synthetic construct
  source 1..20: mol_type = other DNA
gacatttctgaagtcaaatt

SEQ ID NO: 28923 - DNA, 20 bp, synthetic construct
  source 1..20: mol_type = other DNA
gacatttctgacaaccggcc

SEQ ID NO: 28924 - DNA, 20 bp, synthetic construct
  source 1..20: mol_type = other DNA
gacatttctgacacacggaa

SEQ ID NO: 28925 - DNA, 20 bp, synthetic construct
  source 1..20: mol_type = other DNA
gacatttctgacaccggcgg

SEQ ID NO: 28926 - DNA, 20 bp, synthetic construct
  source 1..20: mol_type = other DNA
gacatttctgacacggaatc

SEQ ID NO: 28927 - DNA, 20 bp, synthetic construct
  source 1..20: mol_type = other DNA
gacatttctgacacgtcaat

SEQ ID NO: 28928 - DNA, 20 bp, synthetic construct
  source 1..20: mol_type = other DNA
gacatttctgacataccggc

SEQ ID NO: 28929 - DNA, 20 bp, synthetic construct
  source 1..20: mol_type = other DNA
gacatttctgacatactccc

SEQ ID NO: 28930 - DNA, 20 bp, synthetic construct
  source 1..20: mol_type = other DNA
gacatttctgacatccggcg

SEQ ID NO: 28931 - DNA, 20 bp, synthetic construct
  source 1..20: mol_type = other DNA
gacatttctgacattactcc

SEQ ID NO: 28932 - DNA, 20 bp, synthetic construct
  source 1..20: mol_type = other DNA
gacatttctgacattcacgg

SEQ ID NO: 28933 - DNA, 20 bp, synthetic construct
  source 1..20: mol_type = other DNA
gacatttctgacattctccc

SEQ ID NO: 28934 - DNA, 20 bp, synthetic construct
  source 1..20: mol_type = other DNA
gacatttctgacattgaacc

SEQ ID NO: 28935 - DNA, 20 bp, synthetic construct
  source 1..20: mol_type = other DNA
gacatttctgacatttaccg

SEQ ID NO: 28936 - DNA, 20 bp, synthetic construct
  source 1..20: mol_type = other DNA
gacatttctgacatttactc

SEQ ID NO: 28937 - DNA, 20 bp, synthetic construct
  source 1..20: mol_type = other DNA
gacatttctgacatttcacc

SEQ ID NO: 28938 - DNA, 20 bp, synthetic construct
  source 1..20: mol_type = other DNA
gacatttctgacatttcatt

SEQ ID NO: 28939 - DNA, 20 bp, synthetic construct
  source 1..20: mol_type = other DNA
gacatttctgacatttcgcc

SEQ ID NO: 28940 - DNA, 20 bp, synthetic construct
  source 1..20: mol_type = other DNA
gacatttctgacatttctcc

SEQ ID NO: 28941 - DNA, 20 bp, synthetic construct
  source 1..20: mol_type = other DNA
gacatttctgacatttctcg

SEQ ID NO: 28942 - DNA, 20 bp, synthetic construct
  source 1..20: mol_type = other DNA
gacatttctgacatttctgc

SEQ ID NO: 28943 - DNA, 20 bp, synthetic construct
  source 1..20: mol_type = other DNA
gacatttctgacatttcttc

SEQ ID NO: 28944 - DNA, 20 bp, synthetic construct
  source 1..20: mol_type = other DNA
gacatttctgacatttcttg

SEQ ID NO: 28945 - DNA, 20 bp, synthetic construct
  source 1..20: mol_type = other DNA
gacatttctgacatttcttt

SEQ ID NO: 28946 - DNA, 20 bp, synthetic construct
  source 1..20: mol_type = other DNA
gacatttctgacgtggtgcc

SEQ ID NO: 28947 - DNA, 20 bp, synthetic construct
  source 1..20: mol_type = other DNA
gacatttctgatactcccga

SEQ ID NO: 28948 - DNA, 20 bp, synthetic construct
  source 1..20: mol_type = other DNA
gacatttctgattcttggca

SEQ ID NO: 28949 - DNA, 20 bp, synthetic construct
  source 1..20: mol_type = other DNA
gacatttctgcaaaggaacc

SEQ ID NO: 28950 - DNA, 20 bp, synthetic construct
  source 1..20: mol_type = other DNA
gacatttctttcttggcaaa

SEQ ID NO: 28951 - DNA, 20 bp, synthetic construct
  source 1..20: mol_type = other DNA
gacatttgaccaaaggaacc

SEQ ID NO: 28952 - DNA, 20 bp, synthetic construct
  source 1..20: mol_type = other DNA
gacattttcctggtggtgcc

SEQ ID NO: 28953 - DNA, 20 bp, synthetic construct
  source 1..20: mol_type = other DNA
gacgagcgaccaaaggaacc

SEQ ID NO: 28954 - DNA, 20 bp, synthetic construct
  source 1..20: mol_type = other DNA
gatccactcctggtggtgcc

SEQ ID NO: 28955 - DNA, 20 bp, synthetic construct
  source 1..20: mol_type = other DNA
gcgtcaattcctttatctga

SEQ ID NO: 28956 - DNA, 20 bp, synthetic construct
  source 1..20: mol_type = other DNA
gtactccctgacatttctga

SEQ ID NO: 28957 - DNA, 20 bp, synthetic construct
  source 1..20: mol_type = other DNA
tggcaaactgacatttctga

SEQ ID NO: 28958 - DNA, 20 bp, synthetic construct
  source 1..20: mol_type = other DNA
tggcaaactgacatttcttg

SEQ ID NO: 28959 - DNA, 20 bp, synthetic construct
  source 1..20: mol_type = other DNA
ttggcaaatgacatttctga

SEQ ID NO: 28960 - DNA, 20 bp, synthetic construct
  source 1..20: mol_type = other DNA
atcgagaatgacatttctga

SEQ ID NO: 28961 - DNA, 20 bp, synthetic construct
  source 1..20: mol_type = other DNA
tacatttctgacatttctga

SEQ ID NO: 28962 - DNA, 20 bp, synthetic construct
  source 1..20: mol_type = other DNA
cacatttctgacatttctga

SEQ ID NO: 28963 - DNA, 20 bp, synthetic construct
  source 1..20: mol_type = other DNA
caaatttctgacatttctga

SEQ ID NO: 28964 - DNA, 20 bp, synthetic construct
  source 1..20: mol_type = other DNA
cgagaatctgacatttctga

SEQ ID NO: 28965 - DNA, 20 bp, synthetic construct
  source 1..20: mol_type = other DNA
cctttatctgacatttctga

SEQ ID NO: 28966 - DNA, 20 bp, synthetic construct
  source 1..20: mol_type = other DNA
gaatcgagaaggaacacgga

SEQ ID NO: 28967 - DNA, 20 bp, synthetic construct
  source 1..20: mol_type = other DNA
ccaaatccctggaacacgga

SEQ ID NO: 28968 - DNA, 20 bp, synthetic construct
  source 1..20: mol_type = other DNA
ccaaatccctggaaccggcg

SEQ ID NO: 28969 - DNA, 20 bp, synthetic construct
  source 1..20: mol_type = other DNA
ccaaatccctggaaggagtg

SEQ ID NO: 28970 - DNA, 20 bp, synthetic construct
  source 1..20: mol_type = other DNA
cccaatccctggaatactcc

SEQ ID NO: 28971 - DNA, 20 bp, synthetic construct
  source 1..20: mol_type = other DNA
tggcaaacctggaattcttg

SEQ ID NO: 28972 - DNA, 20 bp, synthetic construct
  source 1..20: mol_type = other DNA
gccgtggcgcacctaccggc

SEQ ID NO: 28973 - DNA, 20 bp, synthetic construct
  source 1..20: mol_type = other DNA
aattcctttaacctcgtcaa

SEQ ID NO: 28974 - DNA, 20 bp, synthetic construct
  source 1..20: mol_type = other DNA
aatcaggcgcacctcgtcaa

SEQ ID NO: 28975 - DNA, 20 bp, synthetic construct
  source 1..20: mol_type = other DNA
aatcaggcgcaccttactcc

SEQ ID NO: 28976 - DNA, 20 bp, synthetic construct
  source 1..20: mol_type = other DNA
ccccaggcgcaccttactcc

SEQ ID NO: 28977 - DNA, 240 bp, synthetic construct
  source 1..240: mol_type = other DNA
cacctacggaaaccttgttacgacttttacttcctctagatagtcaagttcgaccgtcttctcagcgctccgccagggccgtgggccgaccccggcggggccgatccgagggcctcactaaaccatccaatcggtagtagcgacgggcggtgtgtacaaagggcagggacttaatcaacgcaagcttatgacccgcacttactgggaattcctcgttcatggggaataattgcaatcccc

SEQ ID NO: 28978 - DNA, 116 bp, synthetic construct
  source 1..116: mol_type = other DNA
gggacgccgaccgctcgggggtcgcgtaactagttagcatgccagagtctcgttcgttatcggaattaaccagacaaatcgctccaccaactaagaacggccatgcaccaccaccc

SEQ ID NO: 28979 - DNA, 296 bp, synthetic construct
  source 1..296: mol_type = other DNA
gtttatggtcggaactacgacggtatctgatcgtcttcgaacctccgactttcgttcttgattaatgaaaacattcttggcaaatgctttcgctctggtccgtcttgcgccggtccaagaatttcacctctagcggcgcaatacgaatgcccccggccgtccctcttaatcatggcctcagttccgaaaaccaacaaaatagaaccgcggtcctattccattattcctagctgcggtatccaggcggctcgggcctgctttgaacactctaattttttcaaagtaaacgcttcggg

SEQ ID NO: 28980 - DNA, 80 bp, synthetic construct
  source 1..80: mol_type = other DNA
agagcatcgagggggcgccgagaggcaaggggcggggacgggcggtggctcgcctcgcggcggaccgcccgcccgctccc

SEQ ID NO: 28981 - DNA, 10 bp, synthetic construct
  source 1..10: mol_type = other DNA
tacgagcttt

SEQ ID NO: 28982 - DNA, 120 bp, synthetic construct
  source 1..120: mol_type = other DNA
atacgctattggagctggaattaccgcggctgctggcaccagacttgccctccaatggatcctcgttaaaggatttaaagtggactcattccaattacagggcctcgaaagagtcctgta

SEQ ID NO: 28983 - DNA, 80 bp, synthetic construct
  source 1..80: mol_type = other DNA
gggggcgtgcgatcggcccgaggttatctagagtcaccaaagccgccggcgcccgccccccggccggggccggagagggg

SEQ ID NO: 28984 - DNA, 203 bp, Homo sapiens; identical to SEQ ID NO: 231
  source 1..203: mol_type = other DNA

SEQ ID NO: 28985 - DNA, 203 bp, Homo sapiens; identical to SEQ ID NO: 232
  source 1..203: mol_type = other DNA

SEQ ID NO: 28986 - DNA, 203 bp, Homo sapiens; identical to SEQ ID NO: 241
  source 1..203: mol_type = other DNA

SEQ ID NO: 28987 - DNA, 203 bp, Homo sapiens; identical to SEQ ID NO: 245
  source 1..203: mol_type = other DNA

SEQ ID NO: 28988 - DNA, 203 bp, Homo sapiens; identical to SEQ ID NO: 254
  source 1..203: mol_type = other DNA

SEQ ID NO: 28989 - DNA, 203 bp, Homo sapiens; identical to SEQ ID NO: 256
  source 1..203: mol_type = other DNA

SEQ ID NO: 28990 - DNA, 203 bp, Homo sapiens; identical to SEQ ID NO: 259
  source 1..203: mol_type = other DNA

SEQ ID NO: 28991 - DNA, 203 bp, Homo sapiens; identical to SEQ ID NO: 261
  source 1..203: mol_type = other DNA

SEQ ID NO: 28992 - DNA, 203 bp, Homo sapiens; identical to SEQ ID NO: 265
  source 1..203: mol_type = other DNA

SEQ ID NO: 28993 - DNA, 203 bp, Homo sapiens; identical to SEQ ID NO: 270
  source 1..203: mol_type = other DNA

SEQ ID NO: 28994 - DNA, 203 bp, Homo sapiens; identical to SEQ ID NO: 271
  source 1..203: mol_type = other DNA

SEQ ID NO: 28995 - DNA, 203 bp, Homo sapiens; identical to SEQ ID NO: 272
  source 1..203: mol_type = other DNA

SEQ ID NO: 28996 - DNA, 203 bp, Homo sapiens; identical to SEQ ID NO: 273
  source 1..203: mol_type = other DNA

SEQ ID NO: 28997 - DNA, 203 bp, Homo sapiens; identical to SEQ ID NO: 275
  source 1..203: mol_type = other DNA

SEQ ID NO: 28998 - DNA, 203 bp, Homo sapiens; identical to SEQ ID NO: 276
  source 1..203: mol_type = other DNA

SEQ ID NO: 28999 - DNA, 203 bp, Homo sapiens; identical to SEQ ID NO: 278
  source 1..203: mol_type = other DNA

SEQ ID NO: 29000 - DNA, 203 bp, Homo sapiens; identical to SEQ ID NO: 290
  source 1..203: mol_type = other DNA

SEQ ID NO: 29001 - DNA, 203 bp, Homo sapiens; identical to SEQ ID NO: 293
  source 1..203: mol_type = other DNA

SEQ ID NO: 29002 - DNA, 203 bp, Homo sapiens; identical to SEQ ID NO: 295
  source 1..203: mol_type = other DNA

SEQ ID NO: 29003 - DNA, 203 bp, Homo sapiens; identical to SEQ ID NO: 296
  source 1..203: mol_type = other DNA

SEQ ID NO: 29004 - DNA, 203 bp, Homo sapiens; identical to SEQ ID NO: 297
  source 1..203: mol_type = other DNA

SEQ ID NO: 29005 - DNA, 203 bp, Homo sapiens; identical to SEQ ID NO: 1
  source 1..203: mol_type = other DNA

SEQ ID NO: 29006 - DNA, 203 bp, Homo sapiens; identical to SEQ ID NO: 300
  source 1..203: mol_type = other DNA

SEQ ID NO: 29007 - DNA, 203 bp, Homo sapiens; identical to SEQ ID NO: 305
  source 1..203: mol_type = other DNA

SEQ ID NO: 29008 - DNA, 203 bp, Homo sapiens; identical to SEQ ID NO: 307
  source 1..203: mol_type = other DNA

SEQ ID NO: 29009 - DNA, 203 bp, Homo sapiens; identical to SEQ ID NO: 308
  source 1..203: mol_type = other DNA

SEQ ID NO: 29010 - DNA, 203 bp, Homo sapiens; identical to SEQ ID NO: 314
  source 1..203: mol_type = other DNA

SEQ ID NO: 29011 - DNA, 203 bp, Homo sapiens; identical to SEQ ID NO: 316
  source 1..203: mol_type = other DNA

SEQ ID NO: 29012 - DNA, 203 bp, Homo sapiens; identical to SEQ ID NO: 317
  source 1..203: mol_type = other DNA

SEQ ID NO: 29013 - DNA, 203 bp, Homo sapiens; identical to SEQ ID NO: 321
  source 1..203: mol_type = other DNA

SEQ ID NO: 29014 - DNA, 203 bp, Homo sapiens; identical to SEQ ID NO: 329
  source 1..203: mol_type = other DNA

SEQ ID NO: 29015 - DNA, 203 bp, Homo sapiens; identical to SEQ ID NO: 335
  source 1..203: mol_type = other DNA

SEQ ID NO: 29016 - DNA, 203 bp, Homo sapiens; identical to SEQ ID NO: 339
  source 1..203: mol_type = other DNA

SEQ ID NO: 29017 - DNA, 203 bp, Homo sapiens; identical to SEQ ID NO: 345
  source 1..203: mol_type = other DNA

SEQ ID NO: 29018 - DNA, 203 bp, Homo sapiens; identical to SEQ ID NO: 348
  source 1..203: mol_type = other DNA

SEQ ID NO: 29019 - DNA, 203 bp, Homo sapiens; identical to SEQ ID NO: 353
  source 1..203: mol_type = other DNA

SEQ ID NO: 29020 - DNA, 203 bp, Homo sapiens; identical to SEQ ID NO: 358
  source 1..203: mol_type = other DNA

SEQ ID NO: 29021 - DNA, 203 bp, Homo sapiens; identical to SEQ ID NO: 360
  source 1..203: mol_type = other DNA

SEQ ID NO: 29022 - DNA, 203 bp, Homo sapiens; identical to SEQ ID NO: 363
  source 1..203: mol_type = other DNA

SEQ ID NO: 29023 - DNA, 203 bp, Homo sapiens; identical to SEQ ID NO: 366
  source 1..203: mol_type = other DNA

SEQ ID NO: 29024 - DNA, 203 bp, Homo sapiens; identical to SEQ ID NO: 377
  source 1..203: mol_type = other DNA

SEQ ID NO: 29025 - DNA, 203 bp, Homo sapiens; identical to SEQ ID NO: 378
  source 1..203: mol_type = other DNA

SEQ ID NO: 29026 - DNA, 203 bp, Homo sapiens; identical to SEQ ID NO: 383
  source 1..203: mol_type = other DNA

SEQ ID NO: 29027 - DNA, 203 bp, Homo sapiens; identical to SEQ ID NO: 394
  source 1..203: mol_type = other DNA

SEQ ID NO: 29028 - DNA, 203 bp, Homo sapiens; identical to SEQ ID NO: 404
  source 1..203: mol_type = other DNA

SEQ ID NO: 29029 - DNA, 203 bp, Homo sapiens; identical to SEQ ID NO: 413
  source 1..203: mol_type = other DNA

SEQ ID NO: 29030 - DNA, 203 bp, Homo sapiens; identical to SEQ ID NO: 416
  source 1..203: mol_type = other DNA

SEQ ID NO: 29031 - DNA, 203 bp, Homo sapiens; identical to SEQ ID NO: 417
  source 1..203: mol_type = other DNA

SEQ ID NO: 29032 - DNA, 203 bp, Homo sapiens; identical to SEQ ID NO: 421
  source 1..203: mol_type = other DNA

SEQ ID NO: 29033 - DNA, 203 bp, Homo sapiens; identical to SEQ ID NO: 424
  source 1..203: mol_type = other DNA

SEQ ID NO: 29034 - DNA, 203 bp, Homo sapiens; identical to SEQ ID NO: 429
  source 1..203: mol_type = other DNA

SEQ ID NO: 29035 - DNA, 203 bp, Homo sapiens; identical to SEQ ID NO: 434
  source 1..203: mol_type = other DNA

SEQ ID NO: 29036 - DNA, 203 bp, Homo sapiens; identical to SEQ ID NO: 441
  source 1..203: mol_type = other DNA

SEQ ID NO: 29037 - DNA, 203 bp, Homo sapiens; identical to SEQ ID NO: 443
  source 1..203: mol_type = other DNA

SEQ ID NO: 29038 - DNA, 203 bp, Homo sapiens; identical to SEQ ID NO: 448
  source 1..203: mol_type = other DNA

SEQ ID NO: 29039 - DNA, 203 bp, Homo sapiens; identical to SEQ ID NO: 450
  source 1..203: mol_type = other DNA

SEQ ID NO: 29040 - DNA, 203 bp, Homo sapiens; identical to SEQ ID NO: 454
  source 1..203: mol_type = other DNA

SEQ ID NO: 29041 - DNA, 203 bp, Homo sapiens; identical to SEQ ID NO: 464
  source 1..203: mol_type = other DNA

SEQ ID NO: 29042 - DNA, 203 bp, Homo sapiens; identical to SEQ ID NO: 466
  source 1..203: mol_type = other DNA

SEQ ID NO: 29043 - DNA, 203 bp, Homo sapiens; identical to SEQ ID NO: 468
  source 1..203: mol_type = other DNA

SEQ ID NO: 29044 - DNA, 203 bp, Homo sapiens; identical to SEQ ID NO: 477
  source 1..203: mol_type = other DNA

SEQ ID NO: 29045 - DNA, 203 bp, Homo sapiens; identical to SEQ ID NO: 482
  source 1..203: mol_type = other DNA

SEQ ID NO: 29046 - DNA, 203 bp, Homo sapiens; identical to SEQ ID NO: 485
  source 1..203: mol_type = other DNA

SEQ ID NO: 29047 - DNA, 203 bp, Homo sapiens; identical to SEQ ID NO: 486
  source 1..203: mol_type = other DNA

SEQ ID NO: 29048 - DNA, 203 bp, Homo sapiens; identical to SEQ ID NO: 487
  source 1..203: mol_type = other DNA

SEQ ID NO: 29049 - DNA, 203 bp, Homo sapiens; identical to SEQ ID NO: 492
  source 1..203: mol_type = other DNA

SEQ ID NO: 29050 - DNA, 203 bp, Homo sapiens; identical to SEQ ID NO: 502
  source 1..203: mol_type = other DNA

SEQ ID NO: 29051 - DNA, 203 bp, Homo sapiens; identical to SEQ ID NO: 507
  source 1..203: mol_type = other DNA

SEQ ID NO: 29052 - DNA, 203 bp, Homo sapiens; identical to SEQ ID NO: 508
  source 1..203: mol_type = other DNA

SEQ ID NO: 29053 - DNA, 203 bp, Homo sapiens; identical to SEQ ID NO: 516
  source 1..203: mol_type = other DNA

SEQ ID NO: 29054 - DNA, 203 bp, Homo sapiens; identical to SEQ ID NO: 521
  source 1..203: mol_type = other DNA

SEQ ID NO: 29055 - DNA, 203 bp, Homo sapiens; identical to SEQ ID NO: 522
  source 1..203: mol_type = other DNA

SEQ ID NO: 29056 - DNA, 203 bp, Homo sapiens; identical to SEQ ID NO: 527
  source 1..203: mol_type = other DNA

SEQ ID NO: 29057 - DNA, 203 bp, Homo sapiens; identical to SEQ ID NO: 528
  source 1..203: mol_type = other DNA

SEQ ID NO: 29058 - DNA, 203 bp, Homo sapiens; identical to SEQ ID NO: 533
  source 1..203: mol_type = other DNA

SEQ ID NO: 29059 - DNA, 203 bp, Homo sapiens; identical to SEQ ID NO: 541
  source 1..203: mol_type = other DNA

SEQ ID NO: 29060 - DNA, 203 bp, Homo sapiens; identical to SEQ ID NO: 545
  source 1..203: mol_type = other DNA

SEQ ID NO: 29061 - DNA, 203 bp, Homo sapiens; identical to SEQ ID NO: 549
  source 1..203: mol_type = other DNA

SEQ ID NO: 29062 - DNA, 203 bp, Homo sapiens; identical to SEQ ID NO: 550
  source 1..203: mol_type = other DNA

SEQ ID NO: 29063 - DNA, 203 bp, Homo sapiens; identical to SEQ ID NO: 553
  source 1..203: mol_type = other DNA

SEQ ID NO: 29064 - DNA, 203 bp, Homo sapiens; identical to SEQ ID NO: 559
  source 1..203: mol_type = other DNA

SEQ ID NO: 29065 - DNA, 203 bp, Homo sapiens; identical to SEQ ID NO: 560
  source 1..203: mol_type = other DNA

SEQ ID NO: 29066 - DNA, 203 bp, Homo sapiens; identical to SEQ ID NO: 561
  source 1..203: mol_type = other DNA

SEQ ID NO: 29067 - DNA, 203 bp, Homo sapiens; identical to SEQ ID NO: 572
  source 1..203: mol_type = other DNA

SEQ ID NO: 29068 - DNA, 203 bp, Homo sapiens; identical to SEQ ID NO: 575
  source 1..203: mol_type = other DNA

SEQ ID NO: 29069 - DNA, 203 bp, Homo sapiens; identical to SEQ ID NO: 576
  source 1..203: mol_type = other DNA

SEQ ID NO: 29070 - DNA, 203 bp, Homo sapiens; identical to SEQ ID NO: 581
  source 1..203: mol_type = other DNA

SEQ ID NO: 29071 - DNA, 203 bp, Homo sapiens; identical to SEQ ID NO: 582
  source 1..203: mol_type = other DNA

SEQ ID NO: 29072 - DNA, 203 bp, Homo sapiens; identical to SEQ ID NO: 585
  source 1..203: mol_type = other DNA

SEQ ID NO: 29073 - DNA, 203 bp, Homo sapiens; identical to SEQ ID NO: 587
  source 1..203: mol_type = other DNA

SEQ ID NO: 29074 - DNA, 203 bp, Homo sapiens; identical to SEQ ID NO: 589
  source 1..203: mol_type = other DNA

SEQ ID NO: 29075 - DNA, 203 bp, Homo sapiens; identical to SEQ ID NO: 590
  source 1..203: mol_type = other DNA

SEQ ID NO: 29076 - DNA, 203 bp, Homo sapiens; identical to SEQ ID NO: 594
  source 1..203: mol_type = other DNA

SEQ ID NO: 29077 - DNA, 203 bp, Homo sapiens; identical to SEQ ID NO: 596
  source 1..203: mol_type = other DNA

SEQ ID NO: 29078 - DNA, 203 bp, Homo sapiens; identical to SEQ ID NO: 598
  source 1..203: mol_type = other DNA

SEQ ID NO: 29079 - DNA, 203 bp, Homo sapiens; identical to SEQ ID NO: 606
  source 1..203: mol_type = other DNA

SEQ ID NO: 29080 - DNA, 203 bp, Homo sapiens; identical to SEQ ID NO: 617
  source 1..203: mol_type = other DNA

SEQ ID NO: 29081 - DNA, 203 bp, Homo sapiens; identical to SEQ ID NO: 619
  source 1..203: mol_type = other DNA

SEQ ID NO: 29082 - DNA, 203 bp, Homo sapiens; identical to SEQ ID NO: 624
  source 1..203: mol_type = other DNA

SEQ ID NO: 29083 - DNA, 203 bp, Homo sapiens; identical to SEQ ID NO: 630
  source 1..203: mol_type = other DNA

SEQ ID NO: 29084 - DNA, 203 bp, Homo sapiens; identical to SEQ ID NO: 633
  source 1..203: mol_type = other DNA

SEQ ID NO: 29085 - DNA, 203 bp, Homo sapiens; identical to SEQ ID NO: 634
  source 1..203: mol_type = other DNA

SEQ ID NO: 29086 - DNA, 203 bp, Homo sapiens; identical to SEQ ID NO: 640
  source 1..203: mol_type = other DNA

SEQ ID NO: 29087 - DNA, 203 bp, Homo sapiens; identical to SEQ ID NO: 641
  source 1..203: mol_type = other DNA

SEQ ID NO: 29088 - DNA, 203 bp, Homo sapiens; identical to SEQ ID NO: 655
  source 1..203: mol_type = other DNA

SEQ ID NO: 29089 - DNA, 203 bp, Homo sapiens; identical to SEQ ID NO: 657
  source 1..203: mol_type = other DNA

SEQ ID NO: 29090 - DNA, 203 bp, Homo sapiens; identical to SEQ ID NO: 660
  source 1..203: mol_type = other DNA

SEQ ID NO: 29091 - DNA, 203 bp, Homo sapiens; identical to SEQ ID NO: 664
  source 1..203: mol_type = other DNA

SEQ ID NO: 29092 - DNA, 203 bp, Homo sapiens; identical to SEQ ID NO: 2
  source 1..203: mol_type = other DNA

SEQ ID NO: 29093 - DNA, 203 bp, Homo sapiens; identical to SEQ ID NO: 668
  source 1..203: mol_type = other DNA

SEQ ID NO: 29094 - DNA, 203 bp, Homo sapiens; identical to SEQ ID NO: 669
  source 1..203: mol_type = other DNA

SEQ ID NO: 29095 - DNA, 203 bp, Homo sapiens; identical to SEQ ID NO: 697
  source 1..203: mol_type = other DNA

SEQ ID NO: 29096 - DNA, 203 bp, Homo sapiens; identical to SEQ ID NO: 703
  source 1..203: mol_type = other DNA

SEQ ID NO: 29097 - DNA, 203 bp, Homo sapiens; identical to SEQ ID NO: 704
  source 1..203: mol_type = other DNA

SEQ ID NO: 29098 - DNA, 203 bp, Homo sapiens; identical to SEQ ID NO: 710
  source 1..203: mol_type = other DNA

SEQ ID NO: 29099 - DNA, 203 bp, Homo sapiens; identical to SEQ ID NO: 711
  source 1..203: mol_type = other DNA

SEQ ID NO: 29100 - DNA, 203 bp, Homo sapiens; identical to SEQ ID NO: 713
  source 1..203: mol_type = other DNA

SEQ ID NO: 29101 - DNA, 203 bp, Homo sapiens; identical to SEQ ID NO: 714
  source 1..203: mol_type = other DNA

SEQ ID NO: 29102 - DNA, 203 bp, Homo sapiens; identical to SEQ ID NO: 717
  source 1..203: mol_type = other DNA

SEQ ID NO: 29103 - DNA, 203 bp, Homo sapiens; identical to SEQ ID NO: 726
  source 1..203: mol_type = other DNA

SEQ ID NO: 29104 - DNA, 203 bp, Homo sapiens; identical to SEQ ID NO: 728
  source 1..203: mol_type = other DNA

SEQ ID NO: 29105 - DNA, 203 bp, Homo sapiens; identical to SEQ ID NO: 732
  source 1..203: mol_type = other DNA

SEQ ID NO: 29106 - DNA, 203 bp, Homo sapiens; identical to SEQ ID NO: 736
  source 1..203: mol_type = other DNA

SEQ ID NO: 29107 - DNA, 203 bp, Homo sapiens; identical to SEQ ID NO: 744
  source 1..203: mol_type = other DNA

SEQ ID NO: 29108 - DNA, 203 bp, Homo sapiens; identical to SEQ ID NO: 746
  source 1..203: mol_type = other DNA

SEQ ID NO: 29109 - DNA, 203 bp, Homo sapiens; identical to SEQ ID NO: 749
  source 1..203: mol_type = other DNA

SEQ ID NO: 29110 - DNA, 203 bp, Homo sapiens; identical to SEQ ID NO: 755
  source 1..203: mol_type = other DNA

SEQ ID NO: 29111 - DNA, 203 bp, Homo sapiens; identical to SEQ ID NO: 756
  source 1..203: mol_type = other DNA

SEQ ID NO: 29112 - DNA, 203 bp, Homo sapiens; identical to SEQ ID NO: 771
  source 1..203: mol_type = other DNA

SEQ ID NO: 29113 - DNA, 203 bp, Homo sapiens; identical to SEQ ID NO: 772
  source 1..203: mol_type = other DNA

SEQ ID NO: 29114 - DNA, 203 bp, Homo sapiens; identical to SEQ ID NO: 774
  source 1..203: mol_type = other DNA

SEQ ID NO: 29115 - DNA, 203 bp, Homo sapiens; identical to SEQ ID NO: 783
  source 1..203: mol_type = other DNA

SEQ ID NO: 29116 - DNA, 203 bp, Homo sapiens; identical to SEQ ID NO: 784
  source 1..203: mol_type = other DNA

SEQ ID NO: 29117 - DNA, 203 bp, Homo sapiens; identical to SEQ ID NO: 786
  source 1..203: mol_type = other DNA

SEQ ID NO: 29118 - DNA, 203 bp, Homo sapiens; identical to SEQ ID NO: 794
  source 1..203: mol_type = other DNA

SEQ ID NO: 29119 - DNA, 203 bp, Homo sapiens; identical to SEQ ID NO: 798
  source 1..203: mol_type = other DNA

SEQ ID NO: 29120 - DNA, 203 bp, Homo sapiens; identical to SEQ ID NO: 799
  source 1..203: mol_type = other DNA

SEQ ID NO: 29121 - DNA, 203 bp, Homo sapiens; identical to SEQ ID NO: 815
  source 1..203: mol_type = other DNA

SEQ ID NO: 29122 - DNA, 203 bp, Homo sapiens; identical to SEQ ID NO: 820
  source 1..203: mol_type = other DNA

SEQ ID NO: 29123 - DNA, 203 bp, Homo sapiens; identical to SEQ ID NO: 822
  source 1..203: mol_type = other DNA

SEQ ID NO: 29124 - DNA, 203 bp, Homo sapiens; identical to SEQ ID NO: 824
  source 1..203: mol_type = other DNA

SEQ ID NO: 29125 - DNA, 203 bp, Homo sapiens; identical to SEQ ID NO: 833
  source 1..203: mol_type = other DNA

SEQ ID NO: 29126 - DNA, 203 bp, Homo sapiens; identical to SEQ ID NO: 834
  source 1..203: mol_type = other DNA

SEQ ID NO: 29127 - DNA, 203 bp, Homo sapiens; identical to SEQ ID NO: 835
  source 1..203: mol_type = other DNA

SEQ ID NO: 29128 - DNA, 203 bp, Homo sapiens; identical to SEQ ID NO: 843
  source 1..203: mol_type = other DNA

SEQ ID NO: 29129 - DNA, 203 bp, Homo sapiens; identical to SEQ ID NO: 844
  source 1..203: mol_type = other DNA

SEQ ID NO: 29130 - DNA, 203 bp, Homo sapiens; identical to SEQ ID NO: 849
  source 1..203: mol_type = other DNA

SEQ ID NO: 29131 - DNA, 203 bp, Homo sapiens; identical to SEQ ID NO: 856
  source 1..203: mol_type = other DNA

SEQ ID NO: 29132 - DNA, 203 bp, Homo sapiens; identical to SEQ ID NO: 860
  source 1..203: mol_type = other DNA

SEQ ID NO: 29133 - DNA, 203 bp, Homo sapiens; identical to SEQ ID NO: 861
  source 1..203: mol_type = other DNA

SEQ ID NO: 29134 - DNA, 203 bp, Homo sapiens; identical to SEQ ID NO: 863
  source 1..203: mol_type = other DNA

SEQ ID NO: 29135 - DNA, 203 bp, Homo sapiens; identical to SEQ ID NO: 865
  source 1..203: mol_type = other DNA

SEQ ID NO: 29136 - DNA, 203 bp, Homo sapiens; identical to SEQ ID NO: 866
  source 1..203: mol_type = other DNA

SEQ ID NO: 29137 - DNA, 203 bp, Homo sapiens; identical to SEQ ID NO: 882
  source 1..203: mol_type = other DNA

SEQ ID NO: 29138 - DNA, 203 bp, Homo sapiens; identical to SEQ ID NO: 885
  source 1..203: mol_type = other DNA

SEQ ID NO: 29139 - DNA, 203 bp, Homo sapiens; identical to SEQ ID NO: 886
  source 1..203: mol_type = other DNA

SEQ ID NO: 29140 - DNA, 203 bp, Homo sapiens; identical to SEQ ID NO: 892
  source 1..203: mol_type = other DNA

SEQ ID NO: 29141 - DNA, 203 bp, Homo sapiens; identical to SEQ ID NO: 893
  source 1..203: mol_type = other DNA

SEQ ID NO: 29142 - DNA, 203 bp, Homo sapiens; identical to SEQ ID NO: 894
  source 1..203: mol_type = other DNA

SEQ ID NO: 29143 - DNA, 203 bp, Homo sapiens; identical to SEQ ID NO: 910
  source 1..203: mol_type = other DNA

SEQ ID NO: 29144 - DNA, 203 bp, Homo sapiens; identical to SEQ ID NO: 917
  source 1..203: mol_type = other DNA

SEQ ID NO: 29145 - DNA, 203 bp, Homo sapiens; identical to SEQ ID NO: 924
  source 1..203: mol_type = other DNA

SEQ ID NO: 29146 - DNA, 203 bp, Homo sapiens; identical to SEQ ID NO: 930
  source 1..203: mol_type = other DNA

SEQ ID NO: 29147 - DNA, 203 bp, Homo sapiens; identical to SEQ ID NO: 931
  source 1..203: mol_type = other DNA

SEQ ID NO: 29148 - DNA, 203 bp, Homo sapiens; identical to SEQ ID NO: 934
  source 1..203: mol_type = other DNA

SEQ ID NO: 29149 - DNA, 203 bp, Homo sapiens; identical to SEQ ID NO: 939
  source 1..203: mol_type = other DNA

SEQ ID NO: 29150 - DNA, 203 bp, Homo sapiens; identical to SEQ ID NO: 940
  source 1..203: mol_type = other DNA

SEQ ID NO: 29151 - DNA, 203 bp, Homo sapiens; identical to SEQ ID NO: 942
  source 1..203: mol_type = other DNA

SEQ ID NO: 29152 - DNA, 203 bp, Homo sapiens; identical to SEQ ID NO: 946
  source 1..203: mol_type = other DNA

SEQ ID NO: 29153 - DNA, 203 bp, Homo sapiens; identical to SEQ ID NO: 948
  source 1..203: mol_type = other DNA

SEQ ID NO: 29154 - DNA, 203 bp, Homo sapiens; identical to SEQ ID NO: 952
  source 1..203: mol_type = other DNA

SEQ ID NO: 29155 - DNA, 203 bp, Homo sapiens; identical to SEQ ID NO: 956
  source 1..203: mol_type = other DNA

SEQ ID NO: 29156 - DNA, 203 bp, Homo sapiens; identical to SEQ ID NO: 959
  source 1..203: mol_type = other DNA

SEQ ID NO: 29157 - DNA, 203 bp, Homo sapiens; identical to SEQ ID NO: 979
  source 1..203: mol_type = other DNA

SEQ ID NO: 29158 - DNA, 203 bp, Homo sapiens; identical to SEQ ID NO: 982
  source 1..203: mol_type = other DNA

SEQ ID NO: 29159 - DNA, 203 bp, Homo sapiens; identical to SEQ ID NO: 984
  source 1..203: mol_type = other DNA

SEQ ID NO: 29160 - DNA, 203 bp, Homo sapiens; identical to SEQ ID NO: 986
  source 1..203: mol_type = other DNA

SEQ ID NO: 29161 - DNA, 203 bp, Homo sapiens; identical to SEQ ID NO: 987
  source 1..203: mol_type = other DNA

SEQ ID NO: 29162 - DNA, 203 bp, Homo sapiens; identical to SEQ ID NO: 988
  source 1..203: mol_type = other DNA

SEQ ID NO: 29163 - DNA, 203 bp, Homo sapiens; identical to SEQ ID NO: 990
  source 1..203: mol_type = other DNA

SEQ ID NO: 29164 - DNA, 203 bp, Homo sapiens; identical to SEQ ID NO: 994
  source 1..203: mol_type = other DNA

SEQ ID NO: 29165 - DNA, 203 bp, Homo sapiens; identical to SEQ ID NO: 1001
  source 1..203: mol_type = other DNA

SEQ ID NO: 29166 - DNA, 203 bp, Homo sapiens; identical to SEQ ID NO: 1007
  source 1..203: mol_type = other DNA

SEQ ID NO: 29167 - DNA, 203 bp, Homo sapiens; identical to SEQ ID NO: 1008
  source 1..203: mol_type = other DNA

SEQ ID NO: 29168 - DNA, 203 bp, Homo sapiens; identical to SEQ ID NO: 1009
  source 1..203: mol_type = other DNA

SEQ ID NO: 29169 - DNA, 203 bp, Homo sapiens; identical to SEQ ID NO: 1019
  source 1..203: mol_type = other DNA

SEQ ID NO: 29170 - DNA, 203 bp, Homo sapiens; identical to SEQ ID NO: 1023
  source 1..203: mol_type = other DNA

SEQ ID NO: 29171 - DNA, 203 bp, Homo sapiens; identical to SEQ ID NO: 1027
  source 1..203: mol_type = other DNA

SEQ ID NO: 29172 - DNA, 203 bp, Homo sapiens; identical to SEQ ID NO: 1038
  source 1..203: mol_type = other DNA

SEQ ID NO: 29173 - DNA, 203 bp, Homo sapiens; identical to SEQ ID NO: 1039
  source 1..203: mol_type = other DNA

SEQ ID NO: 29174 - DNA, 203 bp, Homo sapiens; identical to SEQ ID NO: 1040
  source 1..203: mol_type = other DNA

SEQ ID NO: 29175 - DNA, 203 bp, Homo sapiens; identical to SEQ ID NO: 1044
  source 1..203: mol_type = other DNA

SEQ ID NO: 29176 - DNA, 203 bp, Homo sapiens; identical to SEQ ID NO: 1048
  source 1..203: mol_type = other DNA

SEQ ID NO: 29177 - DNA, 203 bp, Homo sapiens; identical to SEQ ID NO: 1049
  source 1..203: mol_type = other DNA

SEQ ID NO: 29178 - DNA, 203 bp, Homo sapiens; identical to SEQ ID NO: 1056
  source 1..203: mol_type = other DNA

SEQ ID NO: 29179 - DNA, 203 bp, Homo sapiens; identical to SEQ ID NO: 1064
  source 1..203: mol_type = other DNA

SEQ ID NO: 29180 - DNA, 203 bp, Homo sapiens; identical to SEQ ID NO: 1068
  source 1..203: mol_type = other DNA

SEQ ID NO: 29181 - DNA, 203 bp, Homo sapiens; identical to SEQ ID NO: 1069
  source 1..203: mol_type = other DNA

SEQ ID NO: 29182 - DNA, 203 bp, Homo sapiens; identical to SEQ ID NO: 1071
  source 1..203: mol_type = other DNA

SEQ ID NO: 29183 - DNA, 203 bp, Homo sapiens; identical to SEQ ID NO: 1072
  source 1..203: mol_type = other DNA

SEQ ID NO: 29184 - DNA, 203 bp, Homo sapiens; identical to SEQ ID NO: 1073
  source 1..203: mol_type = other DNA

SEQ ID NO: 29185 - DNA, 203 bp, Homo sapiens; identical to SEQ ID NO: 1075
  source 1..203: mol_type = other DNA

SEQ ID NO: 29186 - DNA, 203 bp, Homo sapiens; identical to SEQ ID NO: 1077
  source 1..203: mol_type = other DNA

SEQ ID NO: 29187 - DNA, 203 bp, Homo sapiens; identical to SEQ ID NO: 1078
  source 1..203: mol_type = other DNA

SEQ ID NO: 29188 - DNA, 203 bp, Homo sapiens; identical to SEQ ID NO: 1079
  source 1..203: mol_type = other DNA

SEQ ID NO: 29189 - DNA, 203 bp, Homo sapiens; identical to SEQ ID NO: 1080
  source 1..203: mol_type = other DNA

SEQ ID NO: 29190 - DNA, 203 bp, Homo sapiens; identical to SEQ ID NO: 1082
  source 1..203: mol_type = other DNA

SEQ ID NO: 29191 - DNA, 203 bp, Homo sapiens; identical to SEQ ID NO: 1083
  source 1..203: mol_type = other DNA

SEQ ID NO: 29192 - DNA, 203 bp, Homo sapiens; identical to SEQ ID NO: 1090
  source 1..203: mol_type = other DNA

SEQ ID NO: 29193 - DNA, 203 bp, Homo sapiens; identical to SEQ ID NO: 1097
  source 1..203: mol_type = other DNA

SEQ ID NO: 29194 - DNA, 203 bp, Homo sapiens; identical to SEQ ID NO: 1098
  source 1..203: mol_type = other DNA

SEQ ID NO: 29195 - DNA, 203 bp, Homo sapiens; identical to SEQ ID NO: 1101
  source 1..203: mol_type = other DNA

SEQ ID NO: 29196 - DNA, 203 bp, Homo sapiens; identical to SEQ ID NO: 1106
  source 1..203: mol_type = other DNA

SEQ ID NO: 29197 - DNA, 203 bp, Homo sapiens; identical to SEQ ID NO: 1111
  source 1..203: mol_type = other DNA

SEQ ID NO: 29198 - DNA, 203 bp, Homo sapiens; identical to SEQ ID NO: 1117
  source 1..203: mol_type = other DNA

SEQ ID NO: 29199 - DNA, 203 bp, Homo sapiens; identical to SEQ ID NO: 1120
  source 1..203: mol_type = other DNA

SEQ ID NO: 29200 - DNA, 203 bp, Homo sapiens; identical to SEQ ID NO: 1121
  source 1..203: mol_type = other DNA

SEQ ID NO: 29201 - DNA, 203 bp, Homo sapiens; identical to SEQ ID NO: 1124
  source 1..203: mol_type = other DNA

SEQ ID NO: 29202 - DNA, 203 bp, Homo sapiens; identical to SEQ ID NO: 1125
  source 1..203: mol_type = other DNA

SEQ ID NO: 29203 - DNA, 203 bp, Homo sapiens; identical to SEQ ID NO: 1129
  source 1..203: mol_type = other DNA

SEQ ID NO: 29204 - DNA, 203 bp, Homo sapiens; identical to SEQ ID NO: 1132
  source 1..203: mol_type = other DNA

SEQ ID NO: 29205 - DNA, 203 bp, Homo sapiens; identical to SEQ ID NO: 1133
  source 1..203: mol_type = other DNA

SEQ ID NO: 29206 - DNA, 203 bp, Homo sapiens; identical to SEQ ID NO: 1135
  source 1..203: mol_type = other DNA

SEQ ID NO: 29207 - DNA, 203 bp, Homo sapiens; identical to SEQ ID NO: 1136
  source 1..203: mol_type = other DNA

SEQ ID NO: 29208 - DNA, 203 bp, Homo sapiens; identical to SEQ ID NO: 1140
  source 1..203: mol_type = other DNA

SEQ ID NO: 29209 - DNA, 203 bp, Homo sapiens; identical to SEQ ID NO: 1141
  source 1..203: mol_type = other DNA

SEQ ID NO: 29210 - DNA, 203 bp, Homo sapiens; identical to SEQ ID NO: 1143
  source 1..203: mol_type = other DNA

SEQ ID NO: 29211 - DNA, 203 bp, Homo sapiens; identical to SEQ ID NO: 1151
  source 1..203: mol_type = other DNA

SEQ ID NO: 29212 - DNA, 203 bp, Homo sapiens; identical to SEQ ID NO: 1153
  source 1..203: mol_type = other DNA

SEQ ID NO: 29213 - DNA, 203 bp, Homo sapiens; identical to SEQ ID NO: 1159
  source 1..203: mol_type = other DNA

SEQ ID NO: 29214 - DNA, 203 bp, Homo sapiens; identical to SEQ ID NO: 1161
  source 1..203: mol_type = other DNA

SEQ ID NO: 29215 - DNA, 203 bp, Homo sapiens; identical to SEQ ID NO: 1166
  source 1..203: mol_type = other DNA

SEQ ID NO: 29216 - DNA, 203 bp, Homo sapiens; identical to SEQ ID NO: 1169
  source 1..203: mol_type = other DNA

SEQ ID NO: 29217 - DNA, 203 bp, Homo sapiens; identical to SEQ ID NO: 1170
  source 1..203: mol_type = other DNA

SEQ ID NO: 29218 - DNA, 203 bp, Homo sapiens; identical to SEQ ID NO: 1175
  source 1..203: mol_type = other DNA

SEQ ID NO: 29219 - DNA, 203 bp, Homo sapiens; identical to SEQ ID NO: 1177
  source 1..203: mol_type = other DNA

SEQ ID NO: 29220 - DNA, 203 bp, Homo sapiens; identical to SEQ ID NO: 1178
  source 1..203: mol_type = other DNA

SEQ ID NO: 29221 - DNA, 203 bp, Homo sapiens; identical to SEQ ID NO: 1184
  source 1..203: mol_type = other DNA

SEQ ID NO: 29222 - DNA, 203 bp, Homo sapiens; identical to SEQ ID NO: 1193
  source 1..203: mol_type = other DNA

SEQ ID NO: 29223 - DNA, 203 bp, Homo sapiens; identical to SEQ ID NO: 1194
  source 1..203: mol_type = other DNA

SEQ ID NO: 29224 - DNA, 203 bp, Homo sapiens; identical to SEQ ID NO: 1203
  source 1..203: mol_type = other DNA

SEQ ID NO: 29225 - DNA, 203 bp, Homo sapiens; identical to SEQ ID NO: 1204
  source 1..203: mol_type = other DNA

SEQ ID NO: 29226 - DNA, 203 bp, Homo sapiens; identical to SEQ ID NO: 1205
  source 1..203: mol_type = other DNA

SEQ ID NO: 29227 - DNA, 203 bp, Homo sapiens; identical to SEQ ID NO: 1216
  source 1..203: mol_type = other DNA

SEQ ID NO: 29228 - DNA, 203 bp, Homo sapiens; identical to SEQ ID NO: 1219
  source 1..203: mol_type = other DNA

SEQ ID NO: 29229 - DNA, 203 bp, Homo sapiens; identical to SEQ ID NO: 1229
  source 1..203: mol_type = other DNA

SEQ ID NO: 29230 - DNA, 203 bp, Homo sapiens; identical to SEQ ID NO: 1230
  source 1..203: mol_type = other DNA

SEQ ID NO: 29231 - DNA, 203 bp, Homo sapiens; identical to SEQ ID NO: 1233
  source 1..203: mol_type = other DNA

SEQ ID NO: 29232 - DNA, 203 bp, Homo sapiens; identical to SEQ ID NO: 1243
  source 1..203: mol_type = other DNA

SEQ ID NO: 29233 - DNA, 203 bp, Homo sapiens; identical to SEQ ID NO: 1246
  source 1..203: mol_type = other DNA

SEQ ID NO: 29234 - DNA, 203 bp, Homo sapiens; identical to SEQ ID NO: 1249
  source 1..203: mol_type = other DNA

SEQ ID NO: 29235 - DNA, 203 bp, Homo sapiens; identical to SEQ ID NO: 1252
  source 1..203: mol_type = other DNA

SEQ ID NO: 29236 - DNA, 203 bp, Homo sapiens; identical to SEQ ID NO: 1256
  source 1..203: mol_type = other DNA

SEQ ID NO: 29237 - DNA, 203 bp, Homo sapiens; identical to SEQ ID NO: 3
  source 1..203: mol_type = other DNA

SEQ ID NO: 29238 - DNA, 203 bp, Homo sapiens; identical to SEQ ID NO: 1258
  source 1..203: mol_type = other DNA

SEQ ID NO: 29239 - DNA, 203 bp, Homo sapiens; identical to SEQ ID NO: 4
  source 1..203: mol_type = other DNA

SEQ ID NO: 29240 - DNA, 203 bp, Homo sapiens; identical to SEQ ID NO: 1262
  source 1..203: mol_type = other DNA

SEQ ID NO: 29241 - DNA, 203 bp, Homo sapiens; identical to SEQ ID NO: 1264
  source 1..203: mol_type = other DNA

SEQ ID NO: 29242 - DNA, 203 bp, Homo sapiens; identical to SEQ ID NO: 1265
  source 1..203: mol_type = other DNA

SEQ ID NO: 29243 - DNA, 203 bp, Homo sapiens; identical to SEQ ID NO: 1276
  source 1..203: mol_type = other DNA

SEQ ID NO: 29244 - DNA, 203 bp, Homo sapiens; identical to SEQ ID NO: 1278
  source 1..203: mol_type = other DNA

SEQ ID NO: 29245 - DNA, 203 bp, Homo sapiens; identical to SEQ ID NO: 1283
  source 1..203: mol_type = other DNA

SEQ ID NO: 29246 - DNA, 203 bp, Homo sapiens; identical to SEQ ID NO: 1286
  source 1..203: mol_type = other DNA

SEQ ID NO: 29247 - DNA, 203 bp, Homo sapiens; identical to SEQ ID NO: 1287
  source 1..203: mol_type = other DNA

SEQ ID NO: 29248 - DNA, 203 bp, Homo sapiens; identical to SEQ ID NO: 1288
  source 1..203: mol_type = other DNA

SEQ ID NO: 29249 - DNA, 203 bp, Homo sapiens; identical to SEQ ID NO: 1292
  source 1..203: mol_type = other DNA

SEQ ID NO: 29250 - DNA, 203 bp, Homo sapiens; identical to SEQ ID NO: 1307
  source 1..203: mol_type = other DNA

SEQ ID NO: 29251 - DNA, 203 bp, Homo sapiens; identical to SEQ ID NO: 1309
  source 1..203: mol_type = other DNA

SEQ ID NO: 29252 - DNA, 203 bp, Homo sapiens; identical to SEQ ID NO: 1310
  source 1..203: mol_type = other DNA

SEQ ID NO: 29253 - DNA, 203 bp, Homo sapiens; identical to SEQ ID NO: 1312
  source 1..203: mol_type = other DNA

SEQ ID NO: 29254 - DNA, 203 bp, Homo sapiens; identical to SEQ ID NO: 1319
  source 1..203: mol_type = other DNA

SEQ ID NO: 29255 - DNA, 203 bp, Homo sapiens; identical to SEQ ID NO: 1320
  source 1..203: mol_type = other DNA

SEQ ID NO: 29256 - DNA, 203 bp, Homo sapiens; identical to SEQ ID NO: 1322
  source 1..203: mol_type = other DNA

SEQ ID NO: 29257 - DNA, 203 bp, Homo sapiens; identical to SEQ ID NO: 1325
  source 1..203: mol_type = other DNA

SEQ ID NO: 29258 - DNA, 203 bp, Homo sapiens; identical to SEQ ID NO: 1328
  source 1..203: mol_type = other DNA

SEQ ID NO: 29259 - DNA, 203 bp, Homo sapiens; identical to SEQ ID NO: 1329
  source 1..203: mol_type = other DNA

SEQ ID NO: 29260 - DNA, 203 bp, Homo sapiens; identical to SEQ ID NO: 1330
  source 1..203: mol_type = other DNA

SEQ ID NO: 29261 - DNA, 203 bp, Homo sapiens; identical to SEQ ID NO: 1339
  source 1..203: mol_type = other DNA

SEQ ID NO: 29262 - DNA, 203 bp, Homo sapiens; identical to SEQ ID NO: 1355
  source 1..203: mol_type = other DNA

SEQ ID NO: 29263 - DNA, 203 bp, Homo sapiens; identical to SEQ ID NO: 1358
  source 1..203: mol_type = other DNA

SEQ ID NO: 29264 - DNA, 203 bp, Homo sapiens; identical to SEQ ID NO: 1361
  source 1..203: mol_type = other DNA

SEQ ID NO: 29265 - DNA, 203 bp, Homo sapiens; identical to SEQ ID NO: 1362
  source 1..203: mol_type = other DNA

SEQ ID NO: 29266 - DNA, 203 bp, Homo sapiens; identical to SEQ ID NO: 1366
  source 1..203: mol_type = other DNA

SEQ ID NO: 29267 - DNA, 203 bp, Homo sapiens; identical to SEQ ID NO: 1369
  source 1..203: mol_type = other DNA

SEQ ID NO: 29268 - DNA, 203 bp, Homo sapiens; identical to SEQ ID NO: 1372
  source 1..203: mol_type = other DNA

SEQ ID NO: 29269 - DNA, 203 bp, Homo sapiens; identical to SEQ ID NO: 1375
  source 1..203: mol_type = other DNA

SEQ ID NO: 29270 - DNA, 203 bp, Homo sapiens; identical to SEQ ID NO: 1376
  source 1..203: mol_type = other DNA

SEQ ID NO: 29271 - DNA, 203 bp, Homo sapiens; identical to SEQ ID NO: 1379
  source 1..203: mol_type = other DNA

SEQ ID NO: 29272 - DNA, 203 bp, Homo sapiens; identical to SEQ ID NO: 1384
  source 1..203: mol_type = other DNA

SEQ ID NO: 29273 - DNA, 203 bp, Homo sapiens; identical to SEQ ID NO: 1387
  source 1..203: mol_type = other DNA

SEQ ID NO: 29274 - DNA, 203 bp, Homo sapiens; identical to SEQ ID NO: 1388
  source 1..203: mol_type = other DNA

SEQ ID NO: 29275 - DNA, 203 bp, Homo sapiens; identical to SEQ ID NO: 1389
  source 1..203: mol_type = other DNA

SEQ ID NO: 29276 - DNA, 203 bp, Homo sapiens; identical to SEQ ID NO: 1390
  source 1..203: mol_type = other DNA

SEQ ID NO: 29277 - DNA, 203 bp, Homo sapiens; identical to SEQ ID NO: 1394
  source 1..203: mol_type = other DNA

SEQ ID NO: 29278 - DNA, 203 bp, Homo sapiens; identical to SEQ ID NO: 1395
  source 1..203: mol_type = other DNA

SEQ ID NO: 29279 - DNA, 203 bp, Homo sapiens; identical to SEQ ID NO: 1399
  source 1..203: mol_type = other DNA

SEQ ID NO: 29280 - DNA, 203 bp, Homo sapiens; identical to SEQ ID NO: 1401
  source 1..203: mol_type = other DNA

SEQ ID NO: 29281 - DNA, 203 bp, Homo sapiens; identical to SEQ ID NO: 1403
  source 1..203: mol_type = other DNA

SEQ ID NO: 29282 - DNA, 203 bp, Homo sapiens; identical to SEQ ID NO: 1405
  source 1..203: mol_type = other DNA

SEQ ID NO: 29283 - DNA, 203 bp, Homo sapiens; identical to SEQ ID NO: 1409
  source 1..203: mol_type = other DNA

SEQ ID NO: 29284 - DNA, 203 bp, Homo sapiens; identical to SEQ ID NO: 1410
  source 1..203: mol_type = other DNA

SEQ ID NO: 29285 - DNA, 203 bp, Homo sapiens; identical to SEQ ID NO: 1413
  source 1..203: mol_type = other DNA

SEQ ID NO: 29286 - DNA, 203 bp, Homo sapiens; identical to SEQ ID NO: 1415
  source 1..203: mol_type = other DNA

SEQ ID NO: 29287 - DNA, 203 bp, Homo sapiens; identical to SEQ ID NO: 1417
  source 1..203: mol_type = other DNA

SEQ ID NO: 29288 - DNA, 203 bp, Homo sapiens; identical to SEQ ID NO: 1424
  source 1..203: mol_type = other DNA

SEQ ID NO: 29289 - DNA, 203 bp, Homo sapiens; identical to SEQ ID NO: 1431
  source 1..203: mol_type = other DNA

SEQ ID NO: 29290 - DNA, 203 bp, Homo sapiens; identical to SEQ ID NO: 1432
  source 1..203: mol_type = other DNA

SEQ ID NO: 29291 - DNA, 203 bp, Homo sapiens; identical to SEQ ID NO: 1438
  source 1..203: mol_type = other DNA

SEQ ID NO: 29292 - DNA, 203 bp, Homo sapiens; identical to SEQ ID NO: 1444
  source 1..203: mol_type = other DNA

SEQ ID NO: 29293 - DNA, 203 bp, Homo sapiens; identical to SEQ ID NO: 1458
  source 1..203: mol_type = other DNA

SEQ ID NO: 29294 - DNA, 203 bp, Homo sapiens; identical to SEQ ID NO: 1459
  source 1..203: mol_type = other DNA

SEQ ID NO: 29295 - DNA, 203 bp, Homo sapiens; identical to SEQ ID NO: 1460
  source 1..203: mol_type = other DNA

SEQ ID NO: 29296 - DNA, 203 bp, Homo sapiens; identical to SEQ ID NO: 1464
  source 1..203: mol_type = other DNA

SEQ ID NO: 29297 - DNA, 203 bp, Homo sapiens; identical to SEQ ID NO: 1467
  source 1..203: mol_type = other DNA

SEQ ID NO: 29298 - DNA, 203 bp, Homo sapiens; identical to SEQ ID NO: 1469
  source 1..203: mol_type = other DNA

SEQ ID NO: 29299 - DNA, 203 bp, Homo sapiens; identical to SEQ ID NO: 1474
  source 1..203: mol_type = other DNA

SEQ ID NO: 29300 - DNA, 203 bp, Homo sapiens; identical to SEQ ID NO: 1476
  source 1..203: mol_type = other DNA

SEQ ID NO: 29301 - DNA, 203 bp, Homo sapiens; identical to SEQ ID NO: 1478
  source 1..203: mol_type = other DNA

SEQ ID NO: 29302 - DNA, 203 bp, Homo sapiens; identical to SEQ ID NO: 1480
  source 1..203: mol_type = other DNA

SEQ ID NO: 29303 - DNA, 203 bp, Homo sapiens; identical to SEQ ID NO: 1481
  source 1..203: mol_type = other DNA

SEQ ID NO: 29304 - DNA, 203 bp, Homo sapiens; identical to SEQ ID NO: 1485
  source 1..203: mol_type = other DNA

SEQ ID NO: 29305 - DNA, 203 bp, Homo sapiens; identical to SEQ ID NO: 1493
  source 1..203: mol_type = other DNA

SEQ ID NO: 29306 - DNA, 203 bp, Homo sapiens; identical to SEQ ID NO: 1497
  source 1..203: mol_type = other DNA

SEQ ID NO: 29307 - DNA, 203 bp, Homo sapiens; identical to SEQ ID NO: 1499
  source 1..203: mol_type = other DNA

SEQ ID NO: 29308 - DNA, 203 bp, Homo sapiens; identical to SEQ ID NO: 1502
  source 1..203: mol_type = other DNA

SEQ ID NO: 29309 - DNA, 203 bp, Homo sapiens; identical to SEQ ID NO: 1506
  source 1..203: mol_type = other DNA

SEQ ID NO: 29310 - DNA, 203 bp, Homo sapiens; identical to SEQ ID NO: 1525
  source 1..203: mol_type = other DNA

SEQ ID NO: 29311 - DNA, 203 bp, Homo sapiens; identical to SEQ ID NO: 1527
  source 1..203: mol_type = other DNA

SEQ ID NO: 29312 - DNA, 203 bp, Homo sapiens; identical to SEQ ID NO: 1530
  source 1..203: mol_type = other DNA

SEQ ID NO: 29313 - DNA, 203 bp, Homo sapiens; identical to SEQ ID NO: 1535
  source 1..203: mol_type = other DNA

SEQ ID NO: 29314 - DNA, 203 bp, Homo sapiens; identical to SEQ ID NO: 1538
  source 1..203: mol_type = other DNA

SEQ ID NO: 29315 - DNA, 203 bp, Homo sapiens; identical to SEQ ID NO: 1541
  source 1..203: mol_type = other DNA

SEQ ID NO: 29316 - DNA, 203 bp, Homo sapiens; identical to SEQ ID NO: 1551
  source 1..203: mol_type = other DNA

SEQ ID NO: 29317 - DNA, 203 bp, Homo sapiens; identical to SEQ ID NO: 1555
  source 1..203: mol_type = other DNA

SEQ ID NO: 29318 - DNA, 203 bp, Homo sapiens; identical to SEQ ID NO: 1558
  source 1..203: mol_type = other DNA

SEQ ID NO: 29319 - DNA, 203 bp, Homo sapiens; identical to SEQ ID NO: 1562
  source 1..203: mol_type = other DNA

SEQ ID NO: 29320 - DNA, 203 bp, Homo sapiens; identical to SEQ ID NO: 1568
  source 1..203: mol_type = other DNA

SEQ ID NO: 29321 - DNA, 203 bp, Homo sapiens; identical to SEQ ID NO: 1570
  source 1..203: mol_type = other DNA

SEQ ID NO: 29322 - DNA, 203 bp, Homo sapiens; identical to SEQ ID NO: 1576
  source 1..203: mol_type = other DNA

SEQ ID NO: 29323 - DNA, 203 bp, Homo sapiens; identical to SEQ ID NO: 1577
  source 1..203: mol_type = other DNA

SEQ ID NO: 29324 - DNA, 203 bp, Homo sapiens; identical to SEQ ID NO: 1579
  source 1..203: mol_type = other DNA

SEQ ID NO: 29325 - DNA, 203 bp, Homo sapiens; identical to SEQ ID NO: 1589
  source 1..203: mol_type = other DNA

SEQ ID NO: 29326 - DNA, 203 bp, Homo sapiens; identical to SEQ ID NO: 1590
  source 1..203: mol_type = other DNA

SEQ ID NO: 29327 - DNA, 203 bp, Homo sapiens; identical to SEQ ID NO: 1591
  source 1..203: mol_type = other DNA

SEQ ID NO: 29328 - DNA, 203 bp, Homo sapiens; identical to SEQ ID NO: 1596
  source 1..203: mol_type = other DNA

SEQ ID NO: 29329 - DNA, 203 bp, Homo sapiens; identical to SEQ ID NO: 1597
  source 1..203: mol_type = other DNA

SEQ ID NO: 29330 - DNA, 203 bp, Homo sapiens; identical to SEQ ID NO: 1600
  source 1..203: mol_type = other DNA

SEQ ID NO: 29331 - DNA, 203 bp, Homo sapiens; identical to SEQ ID NO: 1602
  source 1..203: mol_type = other DNA

SEQ ID NO: 29332 - DNA, 203 bp, Homo sapiens; identical to SEQ ID NO: 1610
  source 1..203: mol_type = other DNA

SEQ ID NO: 29333 - DNA, 203 bp, Homo sapiens; identical to SEQ ID NO: 1612
  source 1..203: mol_type = other DNA

SEQ ID NO: 29334 - DNA, 203 bp, Homo sapiens; identical to SEQ ID NO: 1616
  source 1..203: mol_type = other DNA

SEQ ID NO: 29335 - DNA, 203 bp, Homo sapiens; identical to SEQ ID NO: 1618
  source 1..203: mol_type = other DNA

SEQ ID NO: 29336 - DNA, 203 bp, Homo sapiens; identical to SEQ ID NO: 1620
  source 1..203: mol_type = other DNA

SEQ ID NO: 29337 - DNA, 203 bp, Homo sapiens; identical to SEQ ID NO: 1621
  source 1..203: mol_type = other DNA

SEQ ID NO: 29338 - DNA, 203 bp, Homo sapiens; identical to SEQ ID NO: 1637
  source 1..203: mol_type = other DNA

SEQ ID NO: 29339 - DNA, 203 bp, Homo sapiens; identical to SEQ ID NO: 1640
  source 1..203: mol_type = other DNA

SEQ ID NO: 29340 - DNA, 203 bp, Homo sapiens; identical to SEQ ID NO: 1641
  source 1..203: mol_type = other DNA

SEQ ID NO: 29341 - DNA, 203 bp, Homo sapiens; identical to SEQ ID NO: 1645
  source 1..203: mol_type = other DNA

SEQ ID NO: 29342 - DNA, 203 bp, Homo sapiens; identical to SEQ ID NO: 1646
  source 1..203: mol_type = other DNA

SEQ ID NO: 29343 - DNA, 203 bp, Homo sapiens; identical to SEQ ID NO: 1647
  source 1..203: mol_type = other DNA

SEQ ID NO: 29344 - DNA, 203 bp, Homo sapiens; identical to SEQ ID NO: 1650
  source 1..203: mol_type = other DNA

SEQ ID NO: 29345 - DNA, 203 bp, Homo sapiens; identical to SEQ ID NO: 1655
  source 1..203: mol_type = other DNA

SEQ ID NO: 29346 - DNA, 203 bp, Homo sapiens; identical to SEQ ID NO: 1656
  source 1..203: mol_type = other DNA

SEQ ID NO: 29347 - DNA, 203 bp, Homo sapiens; identical to SEQ ID NO: 1657
  source 1..203: mol_type = other DNA

SEQ ID NO: 29348 - DNA, 203 bp, Homo sapiens; identical to SEQ ID NO: 1659
  source 1..203: mol_type = other DNA

SEQ ID NO: 29349 - DNA, 203 bp, Homo sapiens; identical to SEQ ID NO: 1660
  source 1..203: mol_type = other DNA

SEQ ID NO: 29350 - DNA, 203 bp, Homo sapiens; identical to SEQ ID NO: 1661
  source 1..203: mol_type = other DNA

SEQ ID NO: 29351 - DNA, 203 bp, Homo sapiens; identical to SEQ ID NO: 1665
  source 1..203: mol_type = other DNA

SEQ ID NO: 29352 - DNA, 203 bp, Homo sapiens; identical to SEQ ID NO: 1670
  source 1..203: mol_type = other DNA

SEQ ID NO: 29353 - DNA, 203 bp, Homo sapiens; identical to SEQ ID NO: 1673
  source 1..203: mol_type = other DNA

SEQ ID NO: 29354 - DNA, 203 bp, Homo sapiens; identical to SEQ ID NO: 1676
  source 1..203: mol_type = other DNA

SEQ ID NO: 29355 - DNA, 203 bp, Homo sapiens; identical to SEQ ID NO: 1683
  source 1..203: mol_type = other DNA

SEQ ID NO: 29356 - DNA, 203 bp, Homo sapiens; identical to SEQ ID NO: 1695
  source 1..203: mol_type = other DNA

SEQ ID NO: 29357 - DNA, 203 bp, Homo sapiens; identical to SEQ ID NO: 1697
  source 1..203: mol_type = other DNA

SEQ ID NO: 29358 - DNA, 203 bp, Homo sapiens; identical to SEQ ID NO: 1700
  source 1..203: mol_type = other DNA

SEQ ID NO: 29359 - DNA, 203 bp, Homo sapiens; identical to SEQ ID NO: 1701
  source 1..203: mol_type = other DNA

SEQ ID NO: 29360 - DNA, 203 bp, Homo sapiens; identical to SEQ ID NO: 1704
  source 1..203: mol_type = other DNA

SEQ ID NO: 29361 - DNA, 203 bp, Homo sapiens; identical to SEQ ID NO: 1707
  source 1..203: mol_type = other DNA

SEQ ID NO: 29362 - DNA, 203 bp, Homo sapiens; identical to SEQ ID NO: 1709
  source 1..203: mol_type = other DNA

SEQ ID NO: 29363 - DNA, 203 bp, Homo sapiens; identical to SEQ ID NO: 1710
  source 1..203: mol_type = other DNA

SEQ ID NO: 29364 - DNA, 203 bp, Homo sapiens; identical to SEQ ID NO: 5
  source 1..203: mol_type = other DNA

SEQ ID NO: 29365 - DNA, 203 bp, Homo sapiens; identical to SEQ ID NO: 1714
  source 1..203: mol_type = other DNA

SEQ ID NO: 29366 - DNA, 203 bp, Homo sapiens; identical to SEQ ID NO: 1715
  source 1..203: mol_type = other DNA

SEQ ID NO: 29367 - DNA, 203 bp, Homo sapiens; identical to SEQ ID NO: 1718
  source 1..203: mol_type = other DNA

SEQ ID NO: 29368 - DNA, 203 bp, Homo sapiens; identical to SEQ ID NO: 1720
  source 1..203: mol_type = other DNA

SEQ ID NO: 29369 - DNA, 203 bp, Homo sapiens; identical to SEQ ID NO: 1723
  source 1..203: mol_type = other DNA

SEQ ID NO: 29370 - DNA, 203 bp, Homo sapiens; identical to SEQ ID NO: 1724
  source 1..203: mol_type = other DNA

SEQ ID NO: 29371 - DNA, 203 bp, Homo sapiens; identical to SEQ ID NO: 1725
  source 1..203: mol_type = other DNA

SEQ ID NO: 29372 - DNA, 203 bp, Homo sapiens; identical to SEQ ID NO: 1726
  source 1..203: mol_type = other DNA

SEQ ID NO: 29373 - DNA, 203 bp, Homo sapiens; identical to SEQ ID NO: 1727
  source 1..203: mol_type = other DNA

SEQ ID NO: 29374 - DNA, 203 bp, Homo sapiens; identical to SEQ ID NO: 1729
  source 1..203: mol_type = other DNA

SEQ ID NO: 29375 - DNA, 203 bp, Homo sapiens; identical to SEQ ID NO: 1748
  source 1..203: mol_type = other DNA

SEQ ID NO: 29376 - DNA, 203 bp, Homo sapiens; identical to SEQ ID NO: 1756
  source 1..203: mol_type = other DNA

SEQ ID NO: 29377 - DNA, 203 bp, Homo sapiens; identical to SEQ ID NO: 1758
  source 1..203: mol_type = other DNA

SEQ ID NO: 29378 - DNA, 203 bp, Homo sapiens; identical to SEQ ID NO: 1760
  source 1..203: mol_type = other DNA

SEQ ID NO: 29379 - DNA, 203 bp, Homo sapiens; identical to SEQ ID NO: 1766
  source 1..203: mol_type = other DNA

SEQ ID NO: 29380 - DNA, 203 bp, Homo sapiens; identical to SEQ ID NO: 1767
  source 1..203: mol_type = other DNA

SEQ ID NO: 29381 - DNA, 203 bp, Homo sapiens; identical to SEQ ID NO: 1768
  source 1..203: mol_type = other DNA

SEQ ID NO: 29382 - DNA, 203 bp, Homo sapiens; identical to SEQ ID NO: 1778
  source 1..203: mol_type = other DNA

SEQ ID NO: 29383 - DNA, 203 bp, Homo sapiens; identical to SEQ ID NO: 1779
  source 1..203: mol_type = other DNA

SEQ ID NO: 29384 - DNA, 203 bp, Homo sapiens; identical to SEQ ID NO: 1781
  source 1..203: mol_type = other DNA

SEQ ID NO: 29385 - DNA, 203 bp, Homo sapiens; identical to SEQ ID NO: 1782
  source 1..203: mol_type = other DNA

SEQ ID NO: 29386 - DNA, 203 bp, Homo sapiens; identical to SEQ ID NO: 1793
  source 1..203: mol_type = other DNA

SEQ ID NO: 29387 - DNA, 203 bp, Homo sapiens; identical to SEQ ID NO: 1794
  source 1..203: mol_type = other DNA

SEQ ID NO: 29388 - DNA, 203 bp, Homo sapiens; identical to SEQ ID NO: 1795
  source 1..203: mol_type = other DNA

SEQ ID NO: 29389 - DNA, 203 bp, Homo sapiens; identical to SEQ ID NO: 1803
  source 1..203: mol_type = other DNA

SEQ ID NO: 29390 - DNA, 203 bp, Homo sapiens; identical to SEQ ID NO: 1810
  source 1..203: mol_type = other DNA

SEQ ID NO: 29391 - DNA, 203 bp, Homo sapiens; identical to SEQ ID NO: 1814
  source 1..203: mol_type = other DNA

SEQ ID NO: 29392 - DNA, 203 bp, Homo sapiens; identical to SEQ ID NO: 1817
  source 1..203: mol_type = other DNA

SEQ ID NO: 29393 - DNA, 203 bp, Homo sapiens; identical to SEQ ID NO: 1820
  source 1..203: mol_type = other DNA

SEQ ID NO: 29394 - DNA, 203 bp, Homo sapiens; identical to SEQ ID NO: 1822
  source 1..203: mol_type = other DNA

SEQ ID NO: 29395 - DNA, 203 bp, Homo sapiens; identical to SEQ ID NO: 1823
  source 1..203: mol_type = other DNA

SEQ ID NO: 29396 - DNA, 203 bp, Homo sapiens; identical to SEQ ID NO: 1834
  source 1..203: mol_type = other DNA

SEQ ID NO: 29397 - DNA, 203 bp, Homo sapiens; identical to SEQ ID NO: 1835
  source 1..203: mol_type = other DNA

SEQ ID NO: 29398 - DNA, 203 bp, Homo sapiens; identical to SEQ ID NO: 1843
  source 1..203: mol_type = other DNA

SEQ ID NO: 29399 - DNA, 203 bp, Homo sapiens; identical to SEQ ID NO: 1844
  source 1..203: mol_type = other DNA

SEQ ID NO: 29400 - DNA, 203 bp, Homo sapiens; identical to SEQ ID NO: 1850
  source 1..203: mol_type = other DNA

SEQ ID NO: 29401 - DNA, 203 bp, Homo sapiens; identical to SEQ ID NO: 1852
  source 1..203: mol_type = other DNA

SEQ ID NO: 29402 - DNA, 203 bp, Homo sapiens; identical to SEQ ID NO: 1854
  source 1..203: mol_type = other DNA

SEQ ID NO: 29403 - DNA, 203 bp, Homo sapiens; identical to SEQ ID NO: 1855
  source 1..203: mol_type = other DNA

SEQ ID NO: 29404 - DNA, 203 bp, Homo sapiens; identical to SEQ ID NO: 1869
  source 1..203: mol_type = other DNA

SEQ ID NO: 29405 - DNA, 203 bp, Homo sapiens; identical to SEQ ID NO: 1870
  source 1..203: mol_type = other DNA

SEQ ID NO: 29406 - DNA, 203 bp, Homo sapiens; identical to SEQ ID NO: 1879
  source 1..203: mol_type = other DNA

SEQ ID NO: 29407 - DNA, 203 bp, Homo sapiens; identical to SEQ ID NO: 1880
  source 1..203: mol_type = other DNA

SEQ ID NO: 29408 - DNA, 203 bp, Homo sapiens; identical to SEQ ID NO: 1886
  source 1..203: mol_type = other DNA

SEQ ID NO: 29409 - DNA, 203 bp, Homo sapiens; identical to SEQ ID NO: 1888
  source 1..203: mol_type = other DNA

SEQ ID NO: 29410 - DNA, 203 bp, Homo sapiens; identical to SEQ ID NO: 1890
  source 1..203: mol_type = other DNA

SEQ ID NO: 29411 - DNA, 203 bp, Homo sapiens; identical to SEQ ID NO: 1893
  source 1..203: mol_type = other DNA

SEQ ID NO: 29412 - DNA, 203 bp, Homo sapiens; identical to SEQ ID NO: 1896
  source 1..203: mol_type = other DNA

SEQ ID NO: 29413 - DNA, 203 bp, Homo sapiens; identical to SEQ ID NO: 1897
  source 1..203: mol_type = other DNA

SEQ ID NO: 29414 - DNA, 203 bp, Homo sapiens; identical to SEQ ID NO: 1898
  source 1..203: mol_type = other DNA

SEQ ID NO: 29415 - DNA, 203 bp, Homo sapiens; identical to SEQ ID NO: 1899
  source 1..203: mol_type = other DNA

SEQ ID NO: 29416 - DNA, 203 bp, Homo sapiens; identical to SEQ ID NO: 1900
  source 1..203: mol_type = other DNA

SEQ ID NO: 29417 - DNA, 203 bp, Homo sapiens; identical to SEQ ID NO: 1904
  source 1..203: mol_type = other DNA

SEQ ID NO: 29418 - DNA, 203 bp, Homo sapiens; identical to SEQ ID NO: 1905
  source 1..203: mol_type = other DNA

SEQ ID NO: 29419 - DNA, 203 bp, Homo sapiens; identical to SEQ ID NO: 1920
  source 1..203: mol_type = other DNA

SEQ ID NO: 29420 - DNA, 203 bp, Homo sapiens; identical to SEQ ID NO: 1922
  source 1..203: mol_type = other DNA

SEQ ID NO: 29421 - DNA, 203 bp, Homo sapiens; identical to SEQ ID NO: 1926
  source 1..203: mol_type = other DNA

SEQ ID NO: 29422 - DNA, 203 bp, Homo sapiens; identical to SEQ ID NO: 1929
  source 1..203: mol_type = other DNA

SEQ ID NO: 29423 - DNA, 203 bp, Homo sapiens; identical to SEQ ID NO: 1934
  source 1..203: mol_type = other DNA

SEQ ID NO: 29424 - DNA, 203 bp, Homo sapiens; identical to SEQ ID NO: 1935
  source 1..203: mol_type = other DNA

SEQ ID NO: 29425 - DNA, 203 bp, Homo sapiens; identical to SEQ ID NO: 1940
  source 1..203: mol_type = other DNA

SEQ ID NO: 29426 - DNA, 203 bp, Homo sapiens; identical to SEQ ID NO: 1943
  source 1..203: mol_type = other DNA

SEQ ID NO: 29427 - DNA, 203 bp, Homo sapiens; identical to SEQ ID NO: 1945
  source 1..203: mol_type = other DNA

SEQ ID NO: 29428 - DNA, 203 bp, Homo sapiens; identical to SEQ ID NO: 1946
  source 1..203: mol_type = other DNA

SEQ ID NO: 29429 - DNA, 203 bp, Homo sapiens; identical to SEQ ID NO: 1948
  source 1..203: mol_type = other DNA

SEQ ID NO: 29430 - DNA, 203 bp, Homo sapiens; identical to SEQ ID NO: 1949
  source 1..203: mol_type = other DNA

SEQ ID NO: 29431 - DNA, 203 bp, Homo sapiens; identical to SEQ ID NO: 1950
  source 1..203: mol_type = other DNA

SEQ ID NO: 29432 - DNA, 203 bp, Homo sapiens; identical to SEQ ID NO: 1951
  source 1..203: mol_type = other DNA

SEQ ID NO: 29433 - DNA, 203 bp, Homo sapiens; identical to SEQ ID NO: 1952
  source 1..203: mol_type = other DNA

SEQ ID NO: 29434 - DNA, 203 bp, Homo sapiens; identical to SEQ ID NO: 1953
  source 1..203: mol_type = other DNA

SEQ ID NO: 29435 - DNA, 203 bp, Homo sapiens; identical to SEQ ID NO: 1954
  source 1..203: mol_type = other DNA

SEQ ID NO: 29436 - DNA, 203 bp, Homo sapiens; identical to SEQ ID NO: 1955
  source 1..203: mol_type = other DNA

SEQ ID NO: 29437 - DNA, 203 bp, Homo sapiens; identical to SEQ ID NO: 1956
  source 1..203: mol_type = other DNA

SEQ ID NO: 29438 - DNA, 203 bp, Homo sapiens; identical to SEQ ID NO: 1965
  source 1..203: mol_type = other DNA

SEQ ID NO: 29439 - DNA, 203 bp, Homo sapiens; identical to SEQ ID NO: 1970
  source 1..203: mol_type = other DNA

SEQ ID NO: 29440 - DNA, 203 bp, Homo sapiens; identical to SEQ ID NO: 1973
  source 1..203: mol_type = other DNA

SEQ ID NO: 29441 - DNA, 203 bp, Homo sapiens; identical to SEQ ID NO: 1978
  source 1..203: mol_type = other DNA

SEQ ID NO: 29442 - DNA, 203 bp, Homo sapiens; identical to SEQ ID NO: 1979
  source 1..203: mol_type = other DNA

SEQ ID NO: 29443 - DNA, 203 bp, Homo sapiens; identical to SEQ ID NO: 1984
  source 1..203: mol_type = other DNA

SEQ ID NO: 29444 - DNA, 203 bp, Homo sapiens; identical to SEQ ID NO: 1987
  source 1..203: mol_type = other DNA

SEQ ID NO: 29445 - DNA, 203 bp, Homo sapiens; identical to SEQ ID NO: 1990
  source 1..203: mol_type = other DNA

SEQ ID NO: 29446 - DNA, 203 bp, Homo sapiens; identical to SEQ ID NO: 1992
  source 1..203: mol_type = other DNA

SEQ ID NO: 29447 - DNA, 203 bp, Homo sapiens; identical to SEQ ID NO: 1993
  source 1..203: mol_type = other DNA

SEQ ID NO: 29448 - DNA, 203 bp, Homo sapiens; identical to SEQ ID NO: 1999
  source 1..203: mol_type = other DNA

SEQ ID NO: 29449 - DNA, 203 bp, Homo sapiens; identical to SEQ ID NO: 2004
  source 1..203: mol_type = other DNA

SEQ ID NO: 29450 - DNA, 203 bp, Homo sapiens; identical to SEQ ID NO: 2006
  source 1..203: mol_type = other DNA

SEQ ID NO: 29451 - DNA, 203 bp, Homo sapiens; identical to SEQ ID NO: 2035
  source 1..203: mol_type = other DNA

SEQ ID NO: 29452 - DNA, 203 bp, Homo sapiens; identical to SEQ ID NO: 2038
  source 1..203: mol_type = other DNA

SEQ ID NO: 29453 - DNA, 203 bp, Homo sapiens; identical to SEQ ID NO: 2039
  source 1..203: mol_type = other DNA

SEQ ID NO: 29454 - DNA, 203 bp, Homo sapiens; identical to SEQ ID NO: 2040
  source 1..203: mol_type = other DNA

SEQ ID NO: 29455 - DNA, 203 bp, Homo sapiens; identical to SEQ ID NO: 2041
  source 1..203: mol_type = other DNA

SEQ ID NO: 29456 - DNA, 203 bp, Homo sapiens; identical to SEQ ID NO: 2042
  source 1..203: mol_type = other DNA

SEQ ID NO: 29457 - DNA, 203 bp, Homo sapiens; identical to SEQ ID NO: 2043
  source 1..203: mol_type = other DNA

SEQ ID NO: 29458 - DNA, 203 bp, Homo sapiens; identical to SEQ ID NO: 2044
  source 1..203: mol_type = other DNA

SEQ ID NO: 29459 - DNA, 203 bp, Homo sapiens; identical to SEQ ID NO: 2045
  source 1..203: mol_type = other DNA

SEQ ID NO: 29460 - DNA, 203 bp, Homo sapiens; identical to SEQ ID NO: 2046
  source 1..203: mol_type = other DNA

SEQ ID NO: 29461 - DNA, 203 bp, Homo sapiens; identical to SEQ ID NO: 2047
  source 1..203: mol_type = other DNA

SEQ ID NO: 29462 - DNA, 203 bp, Homo sapiens; identical to SEQ ID NO: 2048
  source 1..203: mol_type = other DNA

SEQ ID NO: 29463 - DNA, 203 bp, Homo sapiens; identical to SEQ ID NO: 2049
  source 1..203: mol_type = other DNA

SEQ ID NO: 29464 - DNA, 203 bp, Homo sapiens; identical to SEQ ID NO: 2050
  source 1..203: mol_type = other DNA

SEQ ID NO: 29465 - DNA, 203 bp, Homo sapiens; identical to SEQ ID NO: 2053
  source 1..203: mol_type = other DNA

SEQ ID NO: 29466 - DNA, 203 bp, Homo sapiens; identical to SEQ ID NO: 2055
  source 1..203: mol_type = other DNA

SEQ ID NO: 29467 - DNA, 203 bp, Homo sapiens; identical to SEQ ID NO: 2062
  source 1..203: mol_type = other DNA

SEQ ID NO: 29468 - DNA, 203 bp, Homo sapiens; identical to SEQ ID NO: 2065
  source 1..203: mol_type = other DNA

SEQ ID NO: 29469 - DNA, 203 bp, Homo sapiens; identical to SEQ ID NO: 2068
  source 1..203: mol_type = other DNA

SEQ ID NO: 29470 - DNA, 203 bp, Homo sapiens; identical to SEQ ID NO: 2069
  source 1..203: mol_type = other DNA

SEQ ID NO: 29471 - DNA, 203 bp, Homo sapiens; identical to SEQ ID NO: 2070
  source 1..203: mol_type = other DNA

SEQ ID NO: 29472 - DNA, 203 bp, Homo sapiens; identical to SEQ ID NO: 2071
  source 1..203: mol_type = other DNA

SEQ ID NO: 29473 - DNA, 203 bp, Homo sapiens; identical to SEQ ID NO: 2073
  source 1..203: mol_type = other DNA

SEQ ID NO: 29474 - DNA, 203 bp, Homo sapiens; identical to SEQ ID NO: 2074
  source 1..203: mol_type = other DNA

SEQ ID NO: 29475 - DNA, 203 bp, Homo sapiens; identical to SEQ ID NO: 2075
  source 1..203: mol_type = other DNA

SEQ ID NO: 29476 - DNA, 203 bp, Homo sapiens; identical to SEQ ID NO: 2076
  source 1..203: mol_type = other DNA

SEQ ID NO: 29477 - DNA, 203 bp, Homo sapiens; identical to SEQ ID NO: 2077
  source 1..203: mol_type = other DNA

SEQ ID NO: 29478 - DNA, 203 bp, Homo sapiens; identical to SEQ ID NO: 2087
  source 1..203: mol_type = other DNA

SEQ ID NO: 29479 - DNA, 203 bp, Homo sapiens; identical to SEQ ID NO: 2092
  source 1..203: mol_type = other DNA

SEQ ID NO: 29480 - DNA, 203 bp, Homo sapiens; identical to SEQ ID NO: 2096
  source 1..203: mol_type = other DNA

SEQ ID NO: 29481 - DNA, 203 bp, Homo sapiens; identical to SEQ ID NO: 2103
  source 1..203: mol_type = other DNA

SEQ ID NO: 29482 - DNA, 203 bp, Homo sapiens; identical to SEQ ID NO: 2108
  source 1..203: mol_type = other DNA

SEQ ID NO: 29483 - DNA, 203 bp, Homo sapiens; identical to SEQ ID NO: 2109
  source 1..203: mol_type = other DNA

SEQ ID NO: 29484 - DNA, 203 bp, Homo sapiens; identical to SEQ ID NO: 2110
  source 1..203: mol_type = other DNA

SEQ ID NO: 29485 - DNA, 203 bp, Homo sapiens; identical to SEQ ID NO: 2111
  source 1..203: mol_type = other DNA

SEQ ID NO: 29486 - DNA, 203 bp, Homo sapiens; identical to SEQ ID NO: 2119
  source 1..203: mol_type = other DNA

SEQ ID NO: 29487 - DNA, 203 bp, Homo sapiens; identical to SEQ ID NO: 2122
  source 1..203: mol_type = other DNA

SEQ ID NO: 29488 - DNA, 203 bp, Homo sapiens; identical to SEQ ID NO: 2138
  source 1..203: mol_type = other DNA

SEQ ID NO: 29489 - DNA, 203 bp, Homo sapiens; identical to SEQ ID NO: 2139
  source 1..203: mol_type = other DNA

SEQ ID NO: 29490 - DNA, 203 bp, Homo sapiens; identical to SEQ ID NO: 2142
  source 1..203: mol_type = other DNA

SEQ ID NO: 29491 - DNA, 203 bp, Homo sapiens; identical to SEQ ID NO: 2144
  source 1..203: mol_type = other DNA

SEQ ID NO: 29492 - DNA, 203 bp, Homo sapiens; identical to SEQ ID NO: 2152
  source 1..203: mol_type = other DNA

SEQ ID NO: 29493 - DNA, 203 bp, Homo sapiens; identical to SEQ ID NO: 2165
  source 1..203: mol_type = other DNA

SEQ ID NO: 29494 - DNA, 203 bp, Homo sapiens; identical to SEQ ID NO: 2171
  source 1..203: mol_type = other DNA

SEQ ID NO: 29495 - DNA, 203 bp, Homo sapiens; identical to SEQ ID NO: 2172
  source 1..203: mol_type = other DNA

SEQ ID NO: 29496 - DNA, 203 bp, Homo sapiens; identical to SEQ ID NO: 2176
  source 1..203: mol_type = other DNA

SEQ ID NO: 29497 - DNA, 203 bp, Homo sapiens; identical to SEQ ID NO: 2177
  source 1..203: mol_type = other DNA

SEQ ID NO: 29498 - DNA, 203 bp, Homo sapiens; identical to SEQ ID NO: 2183
  source 1..203: mol_type = other DNA

SEQ ID NO: 29499 - DNA, 203 bp, Homo sapiens; identical to SEQ ID NO: 2184
  source 1..203: mol_type = other DNA

SEQ ID NO: 29500 - DNA, 203 bp, Homo sapiens; identical to SEQ ID NO: 2186
  source 1..203: mol_type = other DNA

SEQ ID NO: 29501 - DNA, 203 bp, Homo sapiens; identical to SEQ ID NO: 2189
  source 1..203: mol_type = other DNA

SEQ ID NO: 29502 - DNA, 203 bp, Homo sapiens; identical to SEQ ID NO: 2190
  source 1..203: mol_type = other DNA

SEQ ID NO: 29503 - DNA, 203 bp, Homo sapiens; identical to SEQ ID NO: 2191
  source 1..203: mol_type = other DNA

SEQ ID NO: 29504 - DNA, 203 bp, Homo sapiens; identical to SEQ ID NO: 2193
  source 1..203: mol_type = other DNA

SEQ ID NO: 29505 - DNA, 203 bp, Homo sapiens; identical to SEQ ID NO: 2198
  source 1..203: mol_type = other DNA

SEQ ID NO: 29506 - DNA, 203 bp, Homo sapiens; identical to SEQ ID NO: 2200
  source 1..203: mol_type = other DNA

SEQ ID NO: 29507 - DNA, 203 bp, Homo sapiens; identical to SEQ ID NO: 2201
  source 1..203: mol_type = other DNA

SEQ ID NO: 29508 - DNA, 203 bp, Homo sapiens; identical to SEQ ID NO: 2202
  source 1..203: mol_type = other DNA

SEQ ID NO: 29509 - DNA, 203 bp, Homo sapiens; identical to SEQ ID NO: 2203
  source 1..203: mol_type = other DNA

SEQ ID NO: 29510 - DNA, 203 bp, Homo sapiens; identical to SEQ ID NO: 2204
  source 1..203: mol_type = other DNA

SEQ ID NO: 29511 - DNA, 203 bp, Homo sapiens; identical to SEQ ID NO: 2212
  source 1..203: mol_type = other DNA

SEQ ID NO: 29512 - DNA, 203 bp, Homo sapiens; identical to SEQ ID NO: 2220
  source 1..203: mol_type = other DNA

SEQ ID NO: 29513 - DNA, 203 bp, Homo sapiens; identical to SEQ ID NO: 2221
  source 1..203: mol_type = other DNA

SEQ ID NO: 29514 - DNA, 203 bp, Homo sapiens; identical to SEQ ID NO: 2222
  source 1..203: mol_type = other DNA

SEQ ID NO: 29515 - DNA, 203 bp, Homo sapiens; identical to SEQ ID NO: 2223
  source 1..203: mol_type = other DNA

SEQ ID NO: 29516 - DNA, 203 bp, Homo sapiens; identical to SEQ ID NO: 2228
  source 1..203: mol_type = other DNA

SEQ ID NO: 29517 - DNA, 203 bp, Homo sapiens; identical to SEQ ID NO: 2229
  source 1..203: mol_type = other DNA

SEQ ID NO: 29518 - DNA, 203 bp, Homo sapiens; identical to SEQ ID NO: 2230
  source 1..203: mol_type = other DNA

SEQ ID NO: 29519 - DNA, 203 bp, Homo sapiens; identical to SEQ ID NO: 2234
  source 1..203: mol_type = other DNA

SEQ ID NO: 29520 - DNA, 203 bp, Homo sapiens; identical to SEQ ID NO: 2235
  source 1..203: mol_type = other DNA

SEQ ID NO: 29521 - DNA, 203 bp, Homo sapiens; identical to SEQ ID NO: 2236
  source 1..203: mol_type = other DNA

SEQ ID NO: 29522 - DNA, 203 bp, Homo sapiens; identical to SEQ ID NO: 2241
  source 1..203: mol_type = other DNA

SEQ ID NO: 29523 - DNA, 203 bp, Homo sapiens; identical to SEQ ID NO: 2242
  source 1..203: mol_type = other DNA

SEQ ID NO: 29524 - DNA, 203 bp, Homo sapiens; identical to SEQ ID NO: 2246
  source 1..203: mol_type = other DNA

SEQ ID NO: 29525 - DNA, 203 bp, Homo sapiens; identical to SEQ ID NO: 2253
  source 1..203: mol_type = other DNA

SEQ ID NO: 29526 - DNA, 203 bp, Homo sapiens; identical to SEQ ID NO: 2254
  source 1..203: mol_type = other DNA

SEQ ID NO: 29527 - DNA, 203 bp, Homo sapiens; identical to SEQ ID NO: 2255
  source 1..203: mol_type = other DNA

SEQ ID NO: 29528 - DNA, 203 bp, Homo sapiens; identical to SEQ ID NO: 2261
  source 1..203: mol_type = other DNA

SEQ ID NO: 29529 - DNA, 203 bp, Homo sapiens; identical to SEQ ID NO: 2290
  source 1..203: mol_type = other DNA

SEQ ID NO: 29530 - DNA, 203 bp, Homo sapiens; identical to SEQ ID NO: 2294
  source 1..203: mol_type = other DNA

SEQ ID NO: 29531 - DNA, 203 bp, Homo sapiens; identical to SEQ ID NO: 2298
  source 1..203: mol_type = other DNA

SEQ ID NO: 29532 - DNA, 203 bp, Homo sapiens; identical to SEQ ID NO: 2300
  source 1..203: mol_type = other DNA

SEQ ID NO: 29533 - DNA, 203 bp, Homo sapiens; identical to SEQ ID NO: 2301
  source 1..203: mol_type = other DNA

SEQ ID NO: 29534 - DNA, 203 bp, Homo sapiens; identical to SEQ ID NO: 2309
  source 1..203: mol_type = other DNA

SEQ ID NO: 29535 - DNA, 203 bp, Homo sapiens; identical to SEQ ID NO: 2320
  source 1..203: mol_type = other DNA

SEQ ID NO: 29536 - DNA, 203 bp, Homo sapiens; identical to SEQ ID NO: 2330
  source 1..203: mol_type = other DNA

SEQ ID NO: 29537 - DNA, 203 bp, Homo sapiens; identical to SEQ ID NO: 2336
  source 1..203: mol_type = other DNA

SEQ ID NO: 29538 - DNA, 203 bp, Homo sapiens; identical to SEQ ID NO: 2340
  source 1..203: mol_type = other DNA

SEQ ID NO: 29539 - DNA, 203 bp, Homo sapiens; identical to SEQ ID NO: 2341
  source 1..203: mol_type = other DNA

SEQ ID NO: 29540 - DNA, 203 bp, Homo sapiens; identical to SEQ ID NO: 2342
  source 1..203: mol_type = other DNA

SEQ ID NO: 29541 - DNA, 203 bp, Homo sapiens; identical to SEQ ID NO: 2343
  source 1..203: mol_type = other DNA

SEQ ID NO: 29542 - DNA, 203 bp, Homo sapiens; identical to SEQ ID NO: 2344
  source 1..203: mol_type = other DNA

SEQ ID NO: 29543 - DNA, 203 bp, Homo sapiens; identical to SEQ ID NO: 2345
  source 1..203: mol_type = other DNA

SEQ ID NO: 29544 - DNA, 203 bp, Homo sapiens; identical to SEQ ID NO: 2346
  source 1..203: mol_type = other DNA

SEQ ID NO: 29545 - DNA, 203 bp, Homo sapiens; identical to SEQ ID NO: 2347
  source 1..203: mol_type = other DNA

SEQ ID NO: 29546 - DNA, 203 bp, Homo sapiens; identical to SEQ ID NO: 2348
  source 1..203: mol_type = other DNA

SEQ ID NO: 29547 - DNA, 203 bp, Homo sapiens; identical to SEQ ID NO: 2350
  source 1..203: mol_type = other DNA

SEQ ID NO: 29548 - DNA, 203 bp, Homo sapiens; identical to SEQ ID NO: 2351
  source 1..203: mol_type = other DNA

SEQ ID NO: 29549 - DNA, 203 bp, Homo sapiens; identical to SEQ ID NO: 2352
  source 1..203: mol_type = other DNA

SEQ ID NO: 29550 - DNA, 203 bp, Homo sapiens; identical to SEQ ID NO: 2353
  source 1..203: mol_type = other DNA

SEQ ID NO: 29551 - DNA, 203 bp, Homo sapiens; identical to SEQ ID NO: 2354
  source 1..203: mol_type = other DNA

SEQ ID NO: 29552 - DNA, 203 bp, Homo sapiens; identical to SEQ ID NO: 2357
  source 1..203: mol_type = other DNA

SEQ ID NO: 29553 - DNA, 203 bp, Homo sapiens; identical to SEQ ID NO: 2358
  source 1..203: mol_type = other DNA

SEQ ID NO: 29554 - DNA, 203 bp, Homo sapiens; identical to SEQ ID NO: 2363
  source 1..203: mol_type = other DNA

SEQ ID NO: 29555 - DNA, 203 bp, Homo sapiens; identical to SEQ ID NO: 2366
  source 1..203: mol_type = other DNA

SEQ ID NO: 29556 - DNA, 203 bp, Homo sapiens; identical to SEQ ID NO: 2368
  source 1..203: mol_type = other DNA

SEQ ID NO: 29557 - DNA, 203 bp, Homo sapiens; identical to SEQ ID NO: 2370
  source 1..203: mol_type = other DNA

SEQ ID NO: 29558 - DNA, 203 bp, Homo sapiens; identical to SEQ ID NO: 2371
  source 1..203: mol_type = other DNA

SEQ ID NO: 29559 - DNA, 203 bp, Homo sapiens; identical to SEQ ID NO: 2372
  source 1..203: mol_type = other DNA

SEQ ID NO: 29560 - DNA, 203 bp, Homo sapiens; identical to SEQ ID NO: 2373
  source 1..203: mol_type = other DNA

SEQ ID NO: 29561 - DNA, 203 bp, Homo sapiens; identical to SEQ ID NO: 2374
  source 1..203: mol_type = other DNA

SEQ ID NO: 29562 - DNA, 203 bp, Homo sapiens; identical to SEQ ID NO: 2375
  source 1..203: mol_type = other DNA

SEQ ID NO: 29563 - DNA, 203 bp, Homo sapiens; identical to SEQ ID NO: 2377
  source 1..203: mol_type = other DNA

SEQ ID NO: 29564 - DNA, 203 bp, Homo sapiens; identical to SEQ ID NO: 2393
  source 1..203: mol_type = other DNA

SEQ ID NO: 29565 - DNA, 203 bp, Homo sapiens; identical to SEQ ID NO: 2394
  source 1..203: mol_type = other DNA

SEQ ID NO: 29566 - DNA, 203 bp, Homo sapiens; identical to SEQ ID NO: 2395
  source 1..203: mol_type = other DNA

SEQ ID NO: 29567 - DNA, 203 bp, Homo sapiens; identical to SEQ ID NO: 2396
  source 1..203: mol_type = other DNA

SEQ ID NO: 29568 - DNA, 203 bp, Homo sapiens; identical to SEQ ID NO: 2397
  source 1..203: mol_type = other DNA

SEQ ID NO: 29569 - DNA, 203 bp, Homo sapiens; identical to SEQ ID NO: 2409
  source 1..203: mol_type = other DNA

SEQ ID NO: 29570 - DNA, 203 bp, Homo sapiens; identical to SEQ ID NO: 2414
  source 1..203: mol_type = other DNA

SEQ ID NO: 29571 - DNA, 203 bp, Homo sapiens; identical to SEQ ID NO: 2419
  source 1..203: mol_type = other DNA

SEQ ID NO: 29572 - DNA, 203 bp, Homo sapiens; identical to SEQ ID NO: 2420
  source 1..203: mol_type = other DNA

SEQ ID NO: 29573 - DNA, 203 bp, Homo sapiens; identical to SEQ ID NO: 2421
  source 1..203: mol_type = other DNA

SEQ ID NO: 29574 - DNA, 203 bp, Homo sapiens; identical to SEQ ID NO: 2422
  source 1..203: mol_type = other DNA

SEQ ID NO: 29575 - DNA, 203 bp, Homo sapiens; identical to SEQ ID NO: 2423
  source 1..203: mol_type = other DNA

SEQ ID NO: 29576 - DNA, 203 bp, Homo sapiens; identical to SEQ ID NO: 2424
  source 1..203: mol_type = other DNA

SEQ ID NO: 29577 - DNA, 203 bp, Homo sapiens; identical to SEQ ID NO: 2430
  source 1..203: mol_type = other DNA

SEQ ID NO: 29578 - DNA, 203 bp, Homo sapiens; identical to SEQ ID NO: 2433
  source 1..203: mol_type = other DNA

SEQ ID NO: 29579 - DNA, 203 bp, Homo sapiens; identical to SEQ ID NO: 2440
  source 1..203: mol_type = other DNA

SEQ ID NO: 29580 - DNA, 203 bp, Homo sapiens; identical to SEQ ID NO: 2459
  source 1..203: mol_type = other DNA

SEQ ID NO: 29581 - DNA, 203 bp, Homo sapiens; identical to SEQ ID NO: 2464
  source 1..203: mol_type = other DNA

SEQ ID NO: 29582 - DNA, 203 bp, Homo sapiens; identical to SEQ ID NO: 2475
  source 1..203: mol_type = other DNA

SEQ ID NO: 29583 - DNA, 203 bp, Homo sapiens; identical to SEQ ID NO: 2479
  source 1..203: mol_type = other DNA

SEQ ID NO: 29584 - DNA, 203 bp, Homo sapiens; identical to SEQ ID NO: 2481
  source 1..203: mol_type = other DNA

SEQ ID NO: 29585 - DNA, 203 bp, Homo sapiens; identical to SEQ ID NO: 2482
  source 1..203: mol_type = other DNA

SEQ ID NO: 29586 - DNA, 203 bp, Homo sapiens; identical to SEQ ID NO: 2483
  source 1..203: mol_type = other DNA

SEQ ID NO: 29587 - DNA, 203 bp, Homo sapiens; identical to SEQ ID NO: 2486
  source 1..203: mol_type = other DNA

SEQ ID NO: 29588 - DNA, 203 bp, Homo sapiens; identical to SEQ ID NO: 2489
  source 1..203: mol_type = other DNA

SEQ ID NO: 29589 - DNA, 203 bp, Homo sapiens; identical to SEQ ID NO: 2497
  source 1..203: mol_type = other DNA

SEQ ID NO: 29590 - DNA, 203 bp, Homo sapiens; identical to SEQ ID NO: 2499
  source 1..203: mol_type = other DNA

SEQ ID NO: 29591 - DNA, 203 bp, Homo sapiens; identical to SEQ ID NO: 2511
  source 1..203: mol_type = other DNA

SEQ ID NO: 29592 - DNA, 203 bp, Homo sapiens; identical to SEQ ID NO: 2517
  source 1..203: mol_type = other DNA

SEQ ID NO: 29593 - DNA, 203 bp, Homo sapiens; identical to SEQ ID NO: 2521
  source 1..203: mol_type = other DNA

SEQ ID NO: 29594 - DNA, 203 bp, Homo sapiens; identical to SEQ ID NO: 2522
  source 1..203: mol_type = other DNA

SEQ ID NO: 29595 - DNA, 203 bp, Homo sapiens; identical to SEQ ID NO: 2523
  source 1..203: mol_type = other DNA

SEQ ID NO: 29596 - DNA, 203 bp, Homo sapiens; identical to SEQ ID NO: 2529
  source 1..203: mol_type = other DNA

SEQ ID NO: 29597 - DNA, 203 bp, Homo sapiens; identical to SEQ ID NO: 2533
  source 1..203: mol_type = other DNA

SEQ ID NO: 29598 - DNA, 203 bp, Homo sapiens; identical to SEQ ID NO: 2534
  source 1..203: mol_type = other DNA

SEQ ID NO: 29599 - DNA, 203 bp, Homo sapiens; identical to SEQ ID NO: 2543
  source 1..203: mol_type = other DNA

SEQ ID NO: 29600 - DNA, 203 bp, Homo sapiens; identical to SEQ ID NO: 2544
  source 1..203: mol_type = other DNA

SEQ ID NO: 29601 - DNA, 203 bp, Homo sapiens; identical to SEQ ID NO: 2545
  source 1..203: mol_type = other DNA

SEQ ID NO: 29602 - DNA, 203 bp, Homo sapiens; identical to SEQ ID NO: 2549
  source 1..203: mol_type = other DNA

SEQ ID NO: 29603 - DNA, 203 bp, Homo sapiens; identical to SEQ ID NO: 2557
  source 1..203: mol_type = other DNA

SEQ ID NO: 29604 - DNA, 203 bp, Homo sapiens; identical to SEQ ID NO: 2567
  source 1..203: mol_type = other DNA

SEQ ID NO: 29605 - DNA, 203 bp, Homo sapiens; identical to SEQ ID NO: 2573
  source 1..203: mol_type = other DNA

SEQ ID NO: 29606 - DNA, 203 bp, Homo sapiens; identical to SEQ ID NO: 2579
  source 1..203: mol_type = other DNA

SEQ ID NO: 29607 - DNA, 203 bp, Homo sapiens; identical to SEQ ID NO: 2595
  source 1..203: mol_type = other DNA

SEQ ID NO: 29608 - DNA, 203 bp, Homo sapiens; identical to SEQ ID NO: 2596
  source 1..203: mol_type = other DNA

SEQ ID NO: 29609 - DNA, 203 bp, Homo sapiens; identical to SEQ ID NO: 2597
  source 1..203: mol_type = other DNA

SEQ ID NO: 29610 - DNA, 203 bp, Homo sapiens; identical to SEQ ID NO: 2598
  source 1..203: mol_type = other DNA

SEQ ID NO: 29611 - DNA, 203 bp, Homo sapiens; identical to SEQ ID NO: 2599
  source 1..203: mol_type = other DNA

SEQ ID NO: 29612 - DNA, 203 bp, Homo sapiens; identical to SEQ ID NO: 2600
  source 1..203: mol_type = other DNA

SEQ ID NO: 29613 - DNA, 203 bp, Homo sapiens; identical to SEQ ID NO: 2601
  source 1..203: mol_type = other DNA

SEQ ID NO: 29614 - DNA, 203 bp, Homo sapiens; identical to SEQ ID NO: 2602
  source 1..203: mol_type = other DNA

SEQ ID NO: 29615 - DNA, 203 bp, Homo sapiens; identical to SEQ ID NO: 2603
  source 1..203: mol_type = other DNA

SEQ ID NO: 29616 - DNA, 203 bp, Homo sapiens; identical to SEQ ID NO: 2604
  source 1..203: mol_type = other DNA

SEQ ID NO: 29617 - DNA, 203 bp, Homo sapiens; identical to SEQ ID NO: 2605
  source 1..203: mol_type = other DNA

SEQ ID NO: 29618 - DNA, 203 bp, Homo sapiens; identical to SEQ ID NO: 2606
  source 1..203: mol_type = other DNA

SEQ ID NO: 29619 - DNA, 203 bp, Homo sapiens; identical to SEQ ID NO: 2615
  source 1..203: mol_type = other DNA

SEQ ID NO: 29620 - DNA, 203 bp, Homo sapiens; identical to SEQ ID NO: 2617
  source 1..203: mol_type = other DNA

SEQ ID NO: 29621 - DNA, 203 bp, Homo sapiens; identical to SEQ ID NO: 2620
  source 1..203: mol_type = other DNA

SEQ ID NO: 29622 - DNA, 203 bp, Homo sapiens; identical to SEQ ID NO: 2626
  source 1..203: mol_type = other DNA

SEQ ID NO: 29623 - DNA, 203 bp, Homo sapiens; identical to SEQ ID NO: 2633
  source 1..203: mol_type = other DNA

SEQ ID NO: 29624 - DNA, 203 bp, Homo sapiens; identical to SEQ ID NO: 2634
  source 1..203: mol_type = other DNA

SEQ ID NO: 29625 - DNA, 203 bp, Homo sapiens; identical to SEQ ID NO: 2635
  source 1..203: mol_type = other DNA

SEQ ID NO: 29626 - DNA, 203 bp, Homo sapiens; identical to SEQ ID NO: 2636
  source 1..203: mol_type = other DNA

SEQ ID NO: 29627 - DNA, 203 bp, Homo sapiens; identical to SEQ ID NO: 2637
  source 1..203: mol_type = other DNA

SEQ ID NO: 29628 - DNA, 203 bp, Homo sapiens; identical to SEQ ID NO: 2638
  source 1..203: mol_type = other DNA

SEQ ID NO: 29629 - DNA, 203 bp, Homo sapiens; identical to SEQ ID NO: 2639
  source 1..203: mol_type = other DNA

SEQ ID NO: 29630 - DNA, 203 bp, Homo sapiens; identical to SEQ ID NO: 2640
  source 1..203: mol_type = other DNA

SEQ ID NO: 29631 - DNA, 203 bp, Homo sapiens; identical to SEQ ID NO: 2642
  source 1..203: mol_type = other DNA

SEQ ID NO: 29632 - DNA, 203 bp, Homo sapiens; identical to SEQ ID NO: 2643
  source 1..203: mol_type = other DNA

SEQ ID NO: 29633 - DNA, 203 bp, Homo sapiens; identical to SEQ ID NO: 2644
  source 1..203: mol_type = other DNA

SEQ ID NO: 29634 - DNA, 203 bp, Homo sapiens; identical to SEQ ID NO: 2645
  source 1..203: mol_type = other DNA

SEQ ID NO: 29635 - DNA, 203 bp, Homo sapiens; identical to SEQ ID NO: 2646
  source 1..203: mol_type = other DNA

SEQ ID NO: 29636 - DNA, 203 bp, Homo sapiens; identical to SEQ ID NO: 2647
  source 1..203: mol_type = other DNA

SEQ ID NO: 29637 - DNA, 203 bp, Homo sapiens; identical to SEQ ID NO: 2648
  source 1..203: mol_type = other DNA

SEQ ID NO: 29638 - DNA, 203 bp, Homo sapiens; identical to SEQ ID NO: 2650
  source 1..203: mol_type = other DNA

SEQ ID NO: 29639 - DNA, 203 bp, Homo sapiens; identical to SEQ ID NO: 2651
  source 1..203: mol_type = other DNA

SEQ ID NO: 29640 - DNA, 203 bp, Homo sapiens; identical to SEQ ID NO: 2652
  source 1..203: mol_type = other DNA

SEQ ID NO: 29641 - DNA, 203 bp, Homo sapiens; identical to SEQ ID NO: 2656
  source 1..203: mol_type = other DNA

SEQ ID NO: 29642 - DNA, 203 bp, Homo sapiens; identical to SEQ ID NO: 2657
  source 1..203: mol_type = other DNA

SEQ ID NO: 29643 - DNA, 203 bp, Homo sapiens; identical to SEQ ID NO: 2658
  source 1..203: mol_type = other DNA

SEQ ID NO: 29644 - DNA, 203 bp, Homo sapiens; identical to SEQ ID NO: 2659
  source 1..203: mol_type = other DNA

SEQ ID NO: 29645 - DNA, 203 bp, Homo sapiens; identical to SEQ ID NO: 2660
  source 1..203: mol_type = other DNA

SEQ ID NO: 29646 - DNA, 203 bp, Homo sapiens; identical to SEQ ID NO: 2661
  source 1..203: mol_type = other DNA

SEQ ID NO: 29647 - DNA, 203 bp, Homo sapiens; identical to SEQ ID NO: 2662
  source 1..203: mol_type = other DNA

SEQ ID NO: 29648 - DNA, 203 bp, Homo sapiens; identical to SEQ ID NO: 2663
  source 1..203: mol_type = other DNA

SEQ ID NO: 29649 - DNA, 203 bp, Homo sapiens; identical to SEQ ID NO: 2664
  source 1..203: mol_type = other DNA

SEQ ID NO: 29650 - DNA, 203 bp, Homo sapiens; identical to SEQ ID NO: 2665
  source 1..203: mol_type = other DNA

SEQ ID NO: 29651 - DNA, 203 bp, Homo sapiens; identical to SEQ ID NO: 2666
  source 1..203: mol_type = other DNA

SEQ ID NO: 29652 - DNA, 203 bp, Homo sapiens; identical to SEQ ID NO: 2667
  source 1..203: mol_type = other DNA

SEQ ID NO: 29653 - DNA, 203 bp, Homo sapiens; identical to SEQ ID NO: 2668
  source 1..203: mol_type = other DNA

SEQ ID NO: 29654 - DNA, 203 bp, Homo sapiens; identical to SEQ ID NO: 2669
  source 1..203: mol_type = other DNA

SEQ ID NO: 29655 - DNA, 203 bp, Homo sapiens; identical to SEQ ID NO: 2670
  source 1..203: mol_type = other DNA

SEQ ID NO: 29656 - DNA, 203 bp, Homo sapiens; identical to SEQ ID NO: 2671
  source 1..203: mol_type = other DNA

SEQ ID NO: 29657 - DNA, 203 bp, Homo sapiens; identical to SEQ ID NO: 2672
  source 1..203: mol_type = other DNA

SEQ ID NO: 29658 - DNA, 203 bp, Homo sapiens; identical to SEQ ID NO: 2673
  source 1..203: mol_type = other DNA

SEQ ID NO: 29659 - DNA, 203 bp, Homo sapiens; identical to SEQ ID NO: 2674
  source 1..203: mol_type = other DNA

SEQ ID NO: 29660 - DNA, 203 bp, Homo sapiens; identical to SEQ ID NO: 2675
  source 1..203: mol_type = other DNA

SEQ ID NO: 29661 - DNA, 203 bp, Homo sapiens; identical to SEQ ID NO: 2676
  source 1..203: mol_type = other DNA

SEQ ID NO: 29662 - DNA, 203 bp, Homo sapiens; identical to SEQ ID NO: 2677
  source 1..203: mol_type = other DNA

SEQ ID NO: 29663 - DNA, 203 bp, Homo sapiens; identical to SEQ ID NO: 2678
  source 1..203: mol_type = other DNA

SEQ ID NO: 29664 - DNA, 203 bp, Homo sapiens; identical to SEQ ID NO: 2685
  source 1..203: mol_type = other DNA

SEQ ID NO: 29665 - DNA, 203 bp, Homo sapiens; identical to SEQ ID NO: 2704
  source 1..203: mol_type = other DNA

SEQ ID NO: 29666 - DNA, 203 bp, Homo sapiens; identical to SEQ ID NO: 2715
  source 1..203: mol_type = other DNA

SEQ ID NO: 29667 - DNA, 203 bp, Homo sapiens; identical to SEQ ID NO: 2716
  source 1..203: mol_type = other DNA

SEQ ID NO: 29668 - DNA, 203 bp, Homo sapiens; identical to SEQ ID NO: 2720
  source 1..203: mol_type = other DNA

SEQ ID NO: 29669 - DNA, 203 bp, Homo sapiens; identical to SEQ ID NO: 2728
  source 1..203: mol_type = other DNA

SEQ ID NO: 29670 - DNA, 203 bp, Homo sapiens; identical to SEQ ID NO: 2735
  source 1..203: mol_type = other DNA

SEQ ID NO: 29671 - DNA, 203 bp, Homo sapiens; identical to SEQ ID NO: 2736
  source 1..203: mol_type = other DNA

SEQ ID NO: 29672 - DNA, 203 bp, Homo sapiens; identical to SEQ ID NO: 2737
  source 1..203: mol_type = other DNA

SEQ ID NO: 29673 - DNA, 203 bp, Homo sapiens; identical to SEQ ID NO: 2738
  source 1..203: mol_type = other DNA

SEQ ID NO: 29674 - DNA, 203 bp, Homo sapiens; identical to SEQ ID NO: 2739
  source 1..203: mol_type = other DNA

SEQ ID NO: 29675 - DNA, 203 bp, Homo sapiens; identical to SEQ ID NO: 2741
  source 1..203: mol_type = other DNA

SEQ ID NO: 29676 - DNA, 203 bp, Homo sapiens; identical to SEQ ID NO: 2751
  source 1..203: mol_type = other DNA

SEQ ID NO: 29677 - DNA, 203 bp, Homo sapiens; identical to SEQ ID NO: 2753
  source 1..203: mol_type = other DNA

SEQ ID NO: 29678 - DNA, 203 bp, Homo sapiens; identical to SEQ ID NO: 2754
  source 1..203: mol_type = other DNA

SEQ ID NO: 29679 - DNA, 203 bp, Homo sapiens; identical to SEQ ID NO: 2755
  source 1..203: mol_type = other DNA

SEQ ID NO: 29680 - DNA, 203 bp, Homo sapiens; identical to SEQ ID NO: 2756
  source 1..203: mol_type = other DNA

SEQ ID NO: 29681 - DNA, 203 bp, Homo sapiens; identical to SEQ ID NO: 2757
  source 1..203: mol_type = other DNA

SEQ ID NO: 29682 - DNA, 203 bp, Homo sapiens; identical to SEQ ID NO: 2758
  source 1..203: mol_type = other DNA

SEQ ID NO: 29683 - DNA, 203 bp, Homo sapiens; identical to SEQ ID NO: 2764
  source 1..203: mol_type = other DNA

SEQ ID NO: 29684 - DNA, 203 bp, Homo sapiens; identical to SEQ ID NO: 2771
  source 1..203: mol_type = other DNA

SEQ ID NO: 29685 - DNA, 203 bp, Homo sapiens; identical to SEQ ID NO: 2777
  source 1..203: mol_type = other DNA

SEQ ID NO: 29686 - DNA, 203 bp, Homo sapiens; identical to SEQ ID NO: 2778
  source 1..203: mol_type = other DNA

SEQ ID NO: 29687 - DNA, 203 bp, Homo sapiens; identical to SEQ ID NO: 2783
  source 1..203: mol_type = other DNA

SEQ ID NO: 29688 - DNA, 203 bp, Homo sapiens; identical to SEQ ID NO: 2787
  source 1..203: mol_type = other DNA

SEQ ID NO: 29689 - DNA, 203 bp, Homo sapiens; identical to SEQ ID NO: 2800
  source 1..203: mol_type = other DNA

SEQ ID NO: 29690 - DNA, 203 bp, Homo sapiens; identical to SEQ ID NO: 2801
  source 1..203: mol_type = other DNA

SEQ ID NO: 29691 - DNA, 203 bp, Homo sapiens; identical to SEQ ID NO: 2813
  source 1..203: mol_type = other DNA

SEQ ID NO: 29692 - DNA, 203 bp, Homo sapiens; identical to SEQ ID NO: 2814
  source 1..203: mol_type = other DNA

SEQ ID NO: 29693 - DNA, 203 bp, Homo sapiens; identical to SEQ ID NO: 2815
  source 1..203: mol_type = other DNA

SEQ ID NO: 29694 - DNA, 203 bp, Homo sapiens; identical to SEQ ID NO: 2816
  source 1..203: mol_type = other DNA

SEQ ID NO: 29695 - DNA, 203 bp, Homo sapiens; identical to SEQ ID NO: 2822
  source 1..203: mol_type = other DNA

SEQ ID NO: 29696 - DNA, 203 bp, Homo sapiens; identical to SEQ ID NO: 2825
  source 1..203: mol_type = other DNA

SEQ ID NO: 29697 - DNA, 203 bp, Homo sapiens; identical to SEQ ID NO: 2828
  source 1..203: mol_type = other DNA

SEQ ID NO: 29698 - DNA, 203 bp, Homo sapiens; identical to SEQ ID NO: 2835
  source 1..203: mol_type = other DNA

SEQ ID NO: 29699 - DNA, 203 bp, Homo sapiens; identical to SEQ ID NO: 2836
  source 1..203: mol_type = other DNA

SEQ ID NO: 29700 - DNA, 203 bp, Homo sapiens; identical to SEQ ID NO: 2837
  source 1..203: mol_type = other DNA

SEQ ID NO: 29701 - DNA, 203 bp, Homo sapiens; identical to SEQ ID NO: 2847
  source 1..203: mol_type = other DNA

SEQ ID NO: 29702 - DNA, 203 bp, Homo sapiens; identical to SEQ ID NO: 2848
  source 1..203: mol_type = other DNA

SEQ ID NO: 29703 - DNA, 203 bp, Homo sapiens; identical to SEQ ID NO: 2849
  source 1..203: mol_type = other DNA

SEQ ID NO: 29704 - DNA, 203 bp, Homo sapiens; identical to SEQ ID NO: 2853
  source 1..203: mol_type = other DNA

SEQ ID NO: 29705 - DNA, 203 bp, Homo sapiens; identical to SEQ ID NO: 2876
  source 1..203: mol_type = other DNA

SEQ ID NO: 29706 - DNA, 203 bp, Homo sapiens; identical to SEQ ID NO: 2879
  source 1..203: mol_type = other DNA

SEQ ID NO: 29707 - DNA, 203 bp, Homo sapiens; identical to SEQ ID NO: 2882
  source 1..203: mol_type = other DNA

SEQ ID NO: 29708 - DNA, 203 bp, Homo sapiens; identical to SEQ ID NO: 2883
  source 1..203: mol_type = other DNA

SEQ ID NO: 29709 - DNA, 203 bp, Homo sapiens; identical to SEQ ID NO: 2886
  source 1..203: mol_type = other DNA

SEQ ID NO: 29710 - DNA, 203 bp, Homo sapiens; identical to SEQ ID NO: 2887
  source 1..203: mol_type = other DNA

SEQ ID NO: 29711 - DNA, 203 bp, Homo sapiens; identical to SEQ ID NO: 2890
  source 1..203: mol_type = other DNA

SEQ ID NO: 29712 - DNA, 203 bp, Homo sapiens; identical to SEQ ID NO: 2891
  source 1..203: mol_type = other DNA

SEQ ID NO: 29713 - DNA, 203 bp, Homo sapiens; identical to SEQ ID NO: 2899
  source 1..203: mol_type = other DNA

SEQ ID NO: 29714 - DNA, 203 bp, Homo sapiens; identical to SEQ ID NO: 2900
  source 1..203: mol_type = other DNA

SEQ ID NO: 29715 - DNA, 203 bp, Homo sapiens; identical to SEQ ID NO: 2908
  source 1..203: mol_type = other DNA

SEQ ID NO: 29716 - DNA, 203 bp, Homo sapiens; identical to SEQ ID NO: 2911
  source 1..203: mol_type = other DNA

SEQ ID NO: 29717 - DNA, 203 bp, Homo sapiens; identical to SEQ ID NO: 2914
  source 1..203: mol_type = other DNA

SEQ ID NO: 29718 - DNA, 203 bp, Homo sapiens; identical to SEQ ID NO: 2921
  source 1..203: mol_type = other DNA

SEQ ID NO: 29719 - DNA, 203 bp, Homo sapiens; identical to SEQ ID NO: 2923
  source 1..203: mol_type = other DNA

SEQ ID NO: 29720 - DNA, 203 bp, Homo sapiens; identical to SEQ ID NO: 2924
  source 1..203: mol_type = other DNA

SEQ ID NO: 29721 - DNA, 203 bp, Homo sapiens; identical to SEQ ID NO: 2927
  source 1..203: mol_type = other DNA

SEQ ID NO: 29722 - DNA, 203 bp, Homo sapiens; identical to SEQ ID NO: 2929
  source 1..203: mol_type = other DNA

SEQ ID NO: 29723 - DNA, 203 bp, Homo sapiens; identical to SEQ ID NO: 2935
  source 1..203: mol_type = other DNA

SEQ ID NO: 29724 - DNA, 203 bp, Homo sapiens; identical to SEQ ID NO: 2938
  source 1..203: mol_type = other DNA

SEQ ID NO: 29725 - DNA, 203 bp, Homo sapiens; identical to SEQ ID NO: 2949
  source 1..203: mol_type = other DNA

SEQ ID NO: 29726 - DNA, 203 bp, Homo sapiens; identical to SEQ ID NO: 2950
  source 1..203: mol_type = other DNA

SEQ ID NO: 29727 - DNA, 203 bp, Homo sapiens; identical to SEQ ID NO: 2956
  source 1..203: mol_type = other DNA

SEQ ID NO: 29728 - DNA, 203 bp, Homo sapiens; identical to SEQ ID NO: 2957
  source 1..203: mol_type = other DNA

SEQ ID NO: 29729 - DNA, 203 bp, Homo sapiens; identical to SEQ ID NO: 2962
  source 1..203: mol_type = other DNA

SEQ ID NO: 29730 - DNA, 203 bp, Homo sapiens; identical to SEQ ID NO: 2963
  source 1..203: mol_type = other DNA

SEQ ID NO: 29731 - DNA, 203 bp, Homo sapiens; identical to SEQ ID NO: 2970
  source 1..203: mol_type = other DNA

SEQ ID NO: 29732 - DNA, 203 bp, Homo sapiens; identical to SEQ ID NO: 2971
  source 1..203: mol_type = other DNA

SEQ ID NO: 29733 - DNA, 203 bp, Homo sapiens; identical to SEQ ID NO: 2975
  source 1..203: mol_type = other DNA

SEQ ID NO: 29734 - DNA, 203 bp, Homo sapiens; identical to SEQ ID NO: 2976
  source 1..203: mol_type = other DNA

SEQ ID NO: 29735 - DNA, 203 bp, Homo sapiens; identical to SEQ ID NO: 2980
  source 1..203: mol_type = other DNA

SEQ ID NO: 29736 - DNA, 203 bp, Homo sapiens; identical to SEQ ID NO: 2981
  source 1..203: mol_type = other DNA

SEQ ID NO: 29737 - DNA, 203 bp, Homo sapiens; identical to SEQ ID NO: 2985
  source 1..203: mol_type = other DNA

SEQ ID NO: 29738 - DNA, 203 bp, Homo sapiens; identical to SEQ ID NO: 2988
  source 1..203: mol_type = other DNA

SEQ ID NO: 29739 - DNA, 203 bp, Homo sapiens; identical to SEQ ID NO: 2989
  source 1..203: mol_type = other DNA

SEQ ID NO: 29740 - DNA, 203 bp, Homo sapiens; identical to SEQ ID NO: 2991
  source 1..203: mol_type = other DNA

SEQ ID NO: 29741 - DNA, 203 bp, Homo sapiens; identical to SEQ ID NO: 2994
  source 1..203: mol_type = other DNA

SEQ ID NO: 29742 - DNA, 203 bp, Homo sapiens; identical to SEQ ID NO: 3003
  source 1..203: mol_type = other DNA

SEQ ID NO: 29743 - DNA, 203 bp, Homo sapiens; identical to SEQ ID NO: 3005
  source 1..203: mol_type = other DNA

SEQ ID NO: 29744 - DNA, 203 bp, Homo sapiens; identical to SEQ ID NO: 3006
  source 1..203: mol_type = other DNA

SEQ ID NO: 29745 - DNA, 203 bp, Homo sapiens; identical to SEQ ID NO: 3007
  source 1..203: mol_type = other DNA

SEQ ID NO: 29746 - DNA, 203 bp, Homo sapiens; identical to SEQ ID NO: 3013
  source 1..203: mol_type = other DNA

SEQ ID NO: 29747 - DNA, 203 bp, Homo sapiens; identical to SEQ ID NO: 3016
  source 1..203: mol_type = other DNA

SEQ ID NO: 29748 - DNA, 203 bp, Homo sapiens; identical to SEQ ID NO: 3017
  source 1..203: mol_type = other DNA

SEQ ID NO: 29749 - DNA, 203 bp, Homo sapiens; identical to SEQ ID NO: 3021
  source 1..203: mol_type = other DNA

SEQ ID NO: 29750 - DNA, 203 bp, Homo sapiens; identical to SEQ ID NO: 3022
  source 1..203: mol_type = other DNA

SEQ ID NO: 29751 - DNA, 203 bp, Homo sapiens; identical to SEQ ID NO: 3028
  source 1..203: mol_type = other DNA

SEQ ID NO: 29752 - DNA, 203 bp, Homo sapiens; identical to SEQ ID NO: 3032
  source 1..203: mol_type = other DNA

SEQ ID NO: 29753 - DNA, 203 bp, Homo sapiens; identical to SEQ ID NO: 3033
  source 1..203: mol_type = other DNA

SEQ ID NO: 29754 - DNA, 203 bp, Homo sapiens; identical to SEQ ID NO: 3038
  source 1..203: mol_type = other DNA

SEQ ID NO: 29755 - DNA, 203 bp, Homo sapiens; identical to SEQ ID NO: 3039
  source 1..203: mol_type = other DNA

SEQ ID NO: 29756 - DNA, 203 bp, Homo sapiens; identical to SEQ ID NO: 3046
  source 1..203: mol_type = other DNA

SEQ ID NO: 29757 - DNA, 203 bp, Homo sapiens; identical to SEQ ID NO: 3050
  source 1..203: mol_type = other DNA

SEQ ID NO: 29758 - DNA, 203 bp, Homo sapiens; identical to SEQ ID NO: 3052
  source 1..203: mol_type = other DNA

SEQ ID NO: 29759 - DNA, 203 bp, Homo sapiens; identical to SEQ ID NO: 3063
  source 1..203: mol_type = other DNA

SEQ ID NO: 29760 - DNA, 203 bp, Homo sapiens; identical to SEQ ID NO: 3068
  source 1..203: mol_type = other DNA

SEQ ID NO: 29761 - DNA, 203 bp, Homo sapiens; identical to SEQ ID NO: 3069
  source 1..203: mol_type = other DNA

SEQ ID NO: 29762 - DNA, 203 bp, Homo sapiens; identical to SEQ ID NO: 3071
  source 1..203: mol_type = other DNA

SEQ ID NO: 29763 - DNA, 203 bp, Homo sapiens; identical to SEQ ID NO: 3077
  source 1..203: mol_type = other DNA

SEQ ID NO: 29764 - DNA, 203 bp, Homo sapiens; identical to SEQ ID NO: 3083
  source 1..203: mol_type = other DNA

SEQ ID NO: 29765 - DNA, 203 bp, Homo sapiens; identical to SEQ ID NO: 3084
  source 1..203: mol_type = other DNA

SEQ ID NO: 29766 - DNA, 203 bp, Homo sapiens; identical to SEQ ID NO: 3088
  source 1..203: mol_type = other DNA

SEQ ID NO: 29767 - DNA, 203 bp, Homo sapiens; identical to SEQ ID NO: 3094
  source 1..203: mol_type = other DNA

SEQ ID NO: 29768 - DNA, 203 bp, Homo sapiens; identical to SEQ ID NO: 3095
  source 1..203: mol_type = other DNA

SEQ ID NO: 29769 - DNA, 203 bp, Homo sapiens; identical to SEQ ID NO: 3097
  source 1..203: mol_type = other DNA

SEQ ID NO: 29770 - DNA, 203 bp, Homo sapiens; identical to SEQ ID NO: 3100
  source 1..203: mol_type = other DNA

SEQ ID NO: 29771 - DNA, 203 bp, Homo sapiens; identical to SEQ ID NO: 3101
  source 1..203: mol_type = other DNA

SEQ ID NO: 29772 - DNA, 203 bp, Homo sapiens; identical to SEQ ID NO: 3106
  source 1..203: mol_type = other DNA

SEQ ID NO: 29773 - DNA, 203 bp, Homo sapiens; identical to SEQ ID NO: 3107
  source 1..203: mol_type = other DNA

SEQ ID NO: 29774 - DNA, 203 bp, Homo sapiens; identical to SEQ ID NO: 3108
  source 1..203: mol_type = other DNA

SEQ ID NO: 29775 - DNA, 203 bp, Homo sapiens; identical to SEQ ID NO: 3111
  source 1..203: mol_type = other DNA

SEQ ID NO: 29776 - DNA, 203 bp, Homo sapiens; identical to SEQ ID NO: 3113
  source 1..203: mol_type = other DNA

SEQ ID NO: 29777 - DNA, 203 bp, Homo sapiens; identical to SEQ ID NO: 3116
  source 1..203: mol_type = other DNA

SEQ ID NO: 29778 - DNA, 203 bp, Homo sapiens; identical to SEQ ID NO: 3118
  source 1..203: mol_type = other DNA

SEQ ID NO: 29779 - DNA, 203 bp, Homo sapiens; identical to SEQ ID NO: 3121
  source 1..203: mol_type = other DNA

SEQ ID NO: 29780 - DNA, 203 bp, Homo sapiens; identical to SEQ ID NO: 3123
  source 1..203: mol_type = other DNA

SEQ ID NO: 29781 - DNA, 203 bp, Homo sapiens; identical to SEQ ID NO: 3125
  source 1..203: mol_type = other DNA

SEQ ID NO: 29782 - DNA, 203 bp, Homo sapiens; identical to SEQ ID NO: 3130
  source 1..203: mol_type = other DNA

SEQ ID NO: 29783 - DNA, 203 bp, Homo sapiens; identical to SEQ ID NO: 3134
  source 1..203: mol_type = other DNA

SEQ ID NO: 29784 - DNA, 203 bp, Homo sapiens; identical to SEQ ID NO: 3140
  source 1..203: mol_type = other DNA

SEQ ID NO: 29785 - DNA, 203 bp, Homo sapiens; identical to SEQ ID NO: 3141
  source 1..203: mol_type = other DNA

SEQ ID NO: 29786 - DNA, 203 bp, Homo sapiens; identical to SEQ ID NO: 3145
  source 1..203: mol_type = other DNA

SEQ ID NO: 29787 - DNA, 203 bp, Homo sapiens; identical to SEQ ID NO: 3163
  source 1..203: mol_type = other DNA

SEQ ID NO: 29788 - DNA, 203 bp, Homo sapiens; identical to SEQ ID NO: 3165
  source 1..203: mol_type = other DNA

SEQ ID NO: 29789 - DNA, 203 bp, Homo sapiens; identical to SEQ ID NO: 3168
  source 1..203: mol_type = other DNA

SEQ ID NO: 29790 - DNA, 203 bp, Homo sapiens; identical to SEQ ID NO: 3169
  source 1..203: mol_type = other DNA

SEQ ID NO: 29791 - DNA, 203 bp, Homo sapiens; identical to SEQ ID NO: 3172
  source 1..203: mol_type = other DNA

SEQ ID NO: 29792 - DNA, 203 bp, Homo sapiens; identical to SEQ ID NO: 3173
  source 1..203: mol_type = other DNA

SEQ ID NO: 29793 - DNA, 203 bp, Homo sapiens; identical to SEQ ID NO: 3175
  source 1..203: mol_type = other DNA

SEQ ID NO: 29794 - DNA, 203 bp, Homo sapiens; identical to SEQ ID NO: 3176
  source 1..203: mol_type = other DNA

SEQ ID NO: 29795 - DNA, 203 bp, Homo sapiens; identical to SEQ ID NO: 3185
  source 1..203: mol_type = other DNA

SEQ ID NO: 29796 - DNA, 203 bp, Homo sapiens; identical to SEQ ID NO: 3186
  source 1..203: mol_type = other DNA

SEQ ID NO: 29797 - DNA, 203 bp, Homo sapiens; identical to SEQ ID NO: 3187
  source 1..203: mol_type = other DNA

SEQ ID NO: 29798 - DNA, 203 bp, Homo sapiens; identical to SEQ ID NO: 3188
  source 1..203: mol_type = other DNA

SEQ ID NO: 29799 - DNA, 203 bp, Homo sapiens; identical to SEQ ID NO: 3197
  source 1..203: mol_type = other DNA

SEQ ID NO: 29800 - DNA, 203 bp, Homo sapiens; identical to SEQ ID NO: 3199
  source 1..203: mol_type = other DNA

SEQ ID NO: 29801 - DNA, 203 bp, Homo sapiens; identical to SEQ ID NO: 3203
  source 1..203: mol_type = other DNA

SEQ ID NO: 29802 - DNA, 203 bp, Homo sapiens; identical to SEQ ID NO: 3208
  source 1..203: mol_type = other DNA

SEQ ID NO: 29803 - DNA, 203 bp, Homo sapiens; identical to SEQ ID NO: 3211
  source 1..203: mol_type = other DNA

SEQ ID NO: 29804 - DNA, 203 bp, Homo sapiens; identical to SEQ ID NO: 3213
  source 1..203: mol_type = other DNA

SEQ ID NO: 29805 - DNA, 203 bp, Homo sapiens; identical to SEQ ID NO: 3216
  source 1..203: mol_type = other DNA

SEQ ID NO: 29806 - DNA, 203 bp, Homo sapiens; identical to SEQ ID NO: 3218
  source 1..203: mol_type = other DNA

SEQ ID NO: 29807 - DNA, 203 bp, Homo sapiens; identical to SEQ ID NO: 3219
  source 1..203: mol_type = other DNA

SEQ ID NO: 29808 - DNA, 203 bp, Homo sapiens; identical to SEQ ID NO: 3224
  source 1..203: mol_type = other DNA

SEQ ID NO: 29809 - DNA, 203 bp, Homo sapiens; identical to SEQ ID NO: 3230
  source 1..203: mol_type = other DNA

SEQ ID NO: 29810 - DNA, 203 bp, Homo sapiens; identical to SEQ ID NO: 3231
  source 1..203: mol_type = other DNA

SEQ ID NO: 29811 - DNA, 203 bp, Homo sapiens; identical to SEQ ID NO: 3233
  source 1..203: mol_type = other DNA

SEQ ID NO: 29812 - DNA, 203 bp, Homo sapiens; identical to SEQ ID NO: 3235
  source 1..203: mol_type = other DNA

SEQ ID NO: 29813 - DNA, 203 bp, Homo sapiens; identical to SEQ ID NO: 3252
  source 1..203: mol_type = other DNA

SEQ ID NO: 29814 - DNA, 203 bp, Homo sapiens; identical to SEQ ID NO: 3265
  source 1..203: mol_type = other DNA

SEQ ID NO: 29815 - DNA, 203 bp, Homo sapiens; identical to SEQ ID NO: 3269
  source 1..203: mol_type = other DNA

SEQ ID NO: 29816 - DNA, 203 bp, Homo sapiens; identical to SEQ ID NO: 3270
  source 1..203: mol_type = other DNA

SEQ ID NO: 29817 - DNA, 203 bp, Homo sapiens; identical to SEQ ID NO: 3271
  source 1..203: mol_type = other DNA

SEQ ID NO: 29818 - DNA, 203 bp, Homo sapiens; identical to SEQ ID NO: 3272
  source 1..203: mol_type = other DNA

SEQ ID NO: 29819 - DNA, 203 bp, Homo sapiens; identical to SEQ ID NO: 3279
  source 1..203: mol_type = other DNA

SEQ ID NO: 29820 - DNA, 203 bp, Homo sapiens; identical to SEQ ID NO: 3282
  source 1..203: mol_type = other DNA

SEQ ID NO: 29821 - DNA, 203 bp, Homo sapiens; identical to SEQ ID NO: 3284
  source 1..203: mol_type = other DNA

SEQ ID NO: 29822 - DNA, 203 bp, Homo sapiens; identical to SEQ ID NO: 3286
  source 1..203: mol_type = other DNA

SEQ ID NO: 29823 - DNA, 203 bp, Homo sapiens; identical to SEQ ID NO: 3287
  source 1..203: mol_type = other DNA

SEQ ID NO: 29824 - DNA, 203 bp, Homo sapiens; identical to SEQ ID NO: 3291
  source 1..203: mol_type = other DNA

SEQ ID NO: 29825 - DNA, 203 bp, Homo sapiens; identical to SEQ ID NO: 3292
  source 1..203: mol_type = other DNA

SEQ ID NO: 29826 - DNA, 203 bp, Homo sapiens; identical to SEQ ID NO: 3294
  source 1..203: mol_type = other DNA

SEQ ID NO: 29827 - DNA, 203 bp, Homo sapiens; identical to SEQ ID NO: 3299
  source 1..203: mol_type = other DNA

SEQ ID NO: 29828 - DNA, 203 bp, Homo sapiens; identical to SEQ ID NO: 3302
  source 1..203: mol_type = other DNA

SEQ ID NO: 29829 - DNA, 203 bp, Homo sapiens; identical to SEQ ID NO: 3303
  source 1..203: mol_type = other DNA

SEQ ID NO: 29830 - DNA, 203 bp, Homo sapiens; identical to SEQ ID NO: 3310
  source 1..203: mol_type = other DNA

SEQ ID NO: 29831 - DNA, 203 bp, Homo sapiens; identical to SEQ ID NO: 3311
  source 1..203: mol_type = other DNA

SEQ ID NO: 29832 - DNA, 203 bp, Homo sapiens; identical to SEQ ID NO: 3315
  source 1..203: mol_type = other DNA

SEQ ID NO: 29833 - DNA, 203 bp, Homo sapiens; identical to SEQ ID NO: 3318
  source 1..203: mol_type = other DNA

SEQ ID NO: 29834 - DNA, 203 bp, Homo sapiens; identical to SEQ ID NO: 3320
  source 1..203: mol_type = other DNA

SEQ ID NO: 29835 - DNA, 203 bp, Homo sapiens; identical to SEQ ID NO: 3323
  source 1..203: mol_type = other DNA

SEQ ID NO: 29836 - DNA, 203 bp, Homo sapiens; identical to SEQ ID NO: 3325
  source 1..203: mol_type = other DNA

SEQ ID NO: 29837 - DNA, 203 bp, Homo sapiens; identical to SEQ ID NO: 3328
  source 1..203: mol_type = other DNA

SEQ ID NO: 29838 - DNA, 203 bp, Homo sapiens; identical to SEQ ID NO: 3336
  source 1..203: mol_type = other DNA

SEQ ID NO: 29839 - DNA, 203 bp, Homo sapiens; identical to SEQ ID NO: 3338
  source 1..203: mol_type = other DNA

SEQ ID NO: 29840 - DNA, 203 bp, Homo sapiens; identical to SEQ ID NO: 3341
  source 1..203: mol_type = other DNA

SEQ ID NO: 29841 - DNA, 203 bp, Homo sapiens; identical to SEQ ID NO: 3345
  source 1..203: mol_type = other DNA

SEQ ID NO: 29842 - DNA, 203 bp, Homo sapiens; identical to SEQ ID NO: 3352
  source 1..203: mol_type = other DNA

SEQ ID NO: 29843 - DNA, 203 bp, Homo sapiens; identical to SEQ ID NO: 3358
  source 1..203: mol_type = other DNA

SEQ ID NO: 29844 - DNA, 203 bp, Homo sapiens; identical to SEQ ID NO: 3359
  source 1..203: mol_type = other DNA

SEQ ID NO: 29845 - DNA, 203 bp, Homo sapiens; identical to SEQ ID NO: 3360
  source 1..203: mol_type = other DNA

SEQ ID NO: 29846 - DNA, 203 bp, Homo sapiens; identical to SEQ ID NO: 3369
  source 1..203: mol_type = other DNA

SEQ ID NO: 29847 - DNA, 203 bp, Homo sapiens; identical to SEQ ID NO: 3370
  source 1..203: mol_type = other DNA

SEQ ID NO: 29848 - DNA, 203 bp, Homo sapiens; identical to SEQ ID NO: 3373
  source 1..203: mol_type = other DNA

SEQ ID NO: 29849 - DNA, 203 bp, Homo sapiens; identical to SEQ ID NO: 3377
  source 1..203: mol_type = other DNA

SEQ ID NO: 29850 - DNA, 203 bp, Homo sapiens; identical to SEQ ID NO: 3396
  source 1..203: mol_type = other DNA

SEQ ID NO: 29851 - DNA, 203 bp, Homo sapiens; identical to SEQ ID NO: 3404
  source 1..203: mol_type = other DNA

SEQ ID NO: 29852 - DNA, 203 bp, Homo sapiens; identical to SEQ ID NO: 3420
  source 1..203: mol_type = other DNA

SEQ ID NO: 29853 - DNA, 203 bp, Homo sapiens; identical to SEQ ID NO: 3428
  source 1..203: mol_type = other DNA

SEQ ID NO: 29854 - DNA, 203 bp, Homo sapiens; identical to SEQ ID NO: 3429
  source 1..203: mol_type = other DNA

SEQ ID NO: 29855 - DNA, 203 bp, Homo sapiens; identical to SEQ ID NO: 3466
  source 1..203: mol_type = other DNA

SEQ ID NO: 29856 - DNA, 203 bp, Homo sapiens; identical to SEQ ID NO: 3486
  source 1..203: mol_type = other DNA

SEQ ID NO: 29857 - DNA, 203 bp, Homo sapiens; identical to SEQ ID NO: 3488
  source 1..203: mol_type = other DNA

SEQ ID NO: 29858 - DNA, 203 bp, Homo sapiens; identical to SEQ ID NO: 3491
  source 1..203: mol_type = other DNA

SEQ ID NO: 29859 - DNA, 203 bp, Homo sapiens; identical to SEQ ID NO: 3493
  source 1..203: mol_type = other DNA

SEQ ID NO: 29860 - DNA, 203 bp, Homo sapiens; identical to SEQ ID NO: 3496
  source 1..203: mol_type = other DNA

SEQ ID NO: 29861 - DNA, 203 bp, Homo sapiens; identical to SEQ ID NO: 3502
  source 1..203: mol_type = other DNA

SEQ ID NO: 29862 - DNA, 203 bp, Homo sapiens; identical to SEQ ID NO: 3503
  source 1..203: mol_type = other DNA

SEQ ID NO: 29863 - DNA, 203 bp, Homo sapiens; identical to SEQ ID NO: 3509
  source 1..203: mol_type = other DNA

SEQ ID NO: 29864 - DNA, 203 bp, Homo sapiens; identical to SEQ ID NO: 3513
  source 1..203: mol_type = other DNA

SEQ ID NO: 29865 - DNA, 203 bp, Homo sapiens; identical to SEQ ID NO: 3525
  source 1..203: mol_type = other DNA

SEQ ID NO: 29866 - DNA, 203 bp, Homo sapiens; identical to SEQ ID NO: 3538
  source 1..203: mol_type = other DNA

SEQ ID NO: 29867 - DNA, 203 bp, Homo sapiens; identical to SEQ ID NO: 3540
  source 1..203: mol_type = other DNA

SEQ ID NO: 29868 - DNA, 203 bp, Homo sapiens; identical to SEQ ID NO: 3541
  source 1..203: mol_type = other DNA

SEQ ID NO: 29869 - DNA, 203 bp, Homo sapiens; identical to SEQ ID NO: 3542
  source 1..203: mol_type = other DNA

SEQ ID NO: 29870 - DNA, 203 bp, Homo sapiens; identical to SEQ ID NO: 3548
  source 1..203: mol_type = other DNA

SEQ ID NO: 29871 - DNA, 203 bp, Homo sapiens; identical to SEQ ID NO: 3551
  source 1..203: mol_type = other DNA

SEQ ID NO: 29872 - DNA, 203 bp, Homo sapiens; identical to SEQ ID NO: 3553
  source 1..203: mol_type = other DNA

SEQ ID NO: 29873 - DNA, 203 bp, Homo sapiens; identical to SEQ ID NO: 3555
  source 1..203: mol_type = other DNA

SEQ ID NO: 29874 - DNA, 203 bp, Homo sapiens; identical to SEQ ID NO: 3557
  source 1..203: mol_type = other DNA

SEQ ID NO: 29875 - DNA, 203 bp, Homo sapiens; identical to SEQ ID NO: 3569
  source 1..203: mol_type = other DNA

SEQ ID NO: 29876 - DNA, 203 bp, Homo sapiens; identical to SEQ ID NO: 3576
  source 1..203: mol_type = other DNA

SEQ ID NO: 29877 - DNA, 203 bp, Homo sapiens; identical to SEQ ID NO: 3586
  source 1..203: mol_type = other DNA

SEQ ID NO: 29878 - DNA, 203 bp, Homo sapiens; identical to SEQ ID NO: 3591
  source 1..203: mol_type = other DNA

SEQ ID NO: 29879 - DNA, 203 bp, Homo sapiens; identical to SEQ ID NO: 3597
  source 1..203: mol_type = other DNA

SEQ ID NO: 29880 - DNA, 203 bp, Homo sapiens; identical to SEQ ID NO: 3605
  source 1..203: mol_type = other DNA

SEQ ID NO: 29881 - DNA, 203 bp, Homo sapiens; identical to SEQ ID NO: 3611
  source 1..203: mol_type = other DNA

SEQ ID NO: 29882 - DNA, 203 bp, Homo sapiens; identical to SEQ ID NO: 3615
  source 1..203: mol_type = other DNA

SEQ ID NO: 29883 - DNA, 203 bp, Homo sapiens; identical to SEQ ID NO: 3618
  source 1..203: mol_type = other DNA

SEQ ID NO: 29884 - DNA, 203 bp, Homo sapiens; identical to SEQ ID NO: 3627
  source 1..203: mol_type = other DNA

SEQ ID NO: 29885 - DNA, 203 bp, Homo sapiens; identical to SEQ ID NO: 3628
  source 1..203: mol_type = other DNA

SEQ ID NO: 29886 - DNA, 203 bp, Homo sapiens; identical to SEQ ID NO: 3629
  source 1..203: mol_type = other DNA

SEQ ID NO: 29887 - DNA, 203 bp, Homo sapiens; identical to SEQ ID NO: 3633
  source 1..203: mol_type = other DNA

SEQ ID NO: 29888 - DNA, 203 bp, Homo sapiens; identical to SEQ ID NO: 3634
  source 1..203: mol_type = other DNA

SEQ ID NO: 29889 - DNA, 203 bp, Homo sapiens; identical to SEQ ID NO: 3637
  source 1..203: mol_type = other DNA

SEQ ID NO: 29890 - DNA, 203 bp, Homo sapiens; identical to SEQ ID NO: 3639
  source 1..203: mol_type = other DNA

SEQ ID NO: 29891 - DNA, 203 bp, Homo sapiens; identical to SEQ ID NO: 3641
  source 1..203: mol_type = other DNA

SEQ ID NO: 29892 - DNA, 203 bp, Homo sapiens; identical to SEQ ID NO: 3655
  source 1..203: mol_type = other DNA

SEQ ID NO: 29893 - DNA, 203 bp, Homo sapiens; identical to SEQ ID NO: 3662
  source 1..203: mol_type = other DNA

SEQ ID NO: 29894 - DNA, 203 bp, Homo sapiens; identical to SEQ ID NO: 3663
  source 1..203: mol_type = other DNA

SEQ ID NO: 29895 - DNA, 203 bp, Homo sapiens; identical to SEQ ID NO: 3673
  source 1..203: mol_type = other DNA

SEQ ID NO: 29896 - DNA, 203 bp, Homo sapiens; identical to SEQ ID NO: 3674
  source 1..203: mol_type = other DNA

SEQ ID NO: 29897 - DNA, 203 bp, Homo sapiens; identical to SEQ ID NO: 3676
  source 1..203: mol_type = other DNA

SEQ ID NO: 29898 - DNA, 203 bp, Homo sapiens; identical to SEQ ID NO: 3677
  source 1..203: mol_type = other DNA

SEQ ID NO: 29899 - DNA, 203 bp, Homo sapiens; identical to SEQ ID NO: 3701
  source 1..203: mol_type = other DNA

SEQ ID NO: 29900 - DNA, 203 bp, Homo sapiens; identical to SEQ ID NO: 3702
  source 1..203: mol_type = other DNA

SEQ ID NO: 29901 - DNA, 203 bp, Homo sapiens; identical to SEQ ID NO: 3703
  source 1..203: mol_type = other DNA

SEQ ID NO: 29902 - DNA, 203 bp, Homo sapiens; identical to SEQ ID NO: 3706
  source 1..203: mol_type = other DNA

SEQ ID NO: 29903 - DNA, 203 bp, Homo sapiens; identical to SEQ ID NO: 3710
  source 1..203: mol_type = other DNA

SEQ ID NO: 29904 - DNA, 203 bp, Homo sapiens; identical to SEQ ID NO: 3720
  source 1..203: mol_type = other DNA

SEQ ID NO: 29905 - DNA, 203 bp, Homo sapiens; identical to SEQ ID NO: 3727
  source 1..203: mol_type = other DNA

SEQ ID NO: 29906 - DNA, 203 bp, Homo sapiens; identical to SEQ ID NO: 3733
  source 1..203: mol_type = other DNA

SEQ ID NO: 29907 - DNA, 203 bp, Homo sapiens; identical to SEQ ID NO: 3744
  source 1..203: mol_type = other DNA

SEQ ID NO: 29908 - DNA, 203 bp, Homo sapiens; identical to SEQ ID NO: 3758
  source 1..203: mol_type = other DNA

SEQ ID NO: 29909 - DNA, 203 bp, Homo sapiens; identical to SEQ ID NO: 3771
  source 1..203: mol_type = other DNA

SEQ ID NO: 29910 - DNA, 203 bp, Homo sapiens; identical to SEQ ID NO: 3773
  source 1..203: mol_type = other DNA

SEQ ID NO: 29911 - DNA, 203 bp, Homo sapiens; identical to SEQ ID NO: 3774
  source 1..203: mol_type = other DNA

SEQ ID NO: 29912 - DNA, 203 bp, Homo sapiens; identical to SEQ ID NO: 3775
  source 1..203: mol_type = other DNA

SEQ ID NO: 29913 - DNA, 203 bp, Homo sapiens; identical to SEQ ID NO: 3777
  source 1..203: mol_type = other DNA

SEQ ID NO: 29914 - DNA, 203 bp, Homo sapiens; identical to SEQ ID NO: 3781
  source 1..203: mol_type = other DNA

SEQ ID NO: 29915 - DNA, 203 bp, Homo sapiens; identical to SEQ ID NO: 3782
  source 1..203: mol_type = other DNA

SEQ ID NO: 29916 - DNA, 203 bp, Homo sapiens; identical to SEQ ID NO: 3785
  source 1..203: mol_type = other DNA

SEQ ID NO: 29917 - DNA, 203 bp, Homo sapiens; identical to SEQ ID NO: 3790
  source 1..203: mol_type = other DNA

SEQ ID NO: 29918 - DNA, 203 bp, Homo sapiens; identical to SEQ ID NO: 3792
  source 1..203: mol_type = other DNA

SEQ ID NO: 29919 - DNA, 203 bp, Homo sapiens; identical to SEQ ID NO: 3793
  source 1..203: mol_type = other DNA

SEQ ID NO: 29920 - DNA, 203 bp, Homo sapiens; identical to SEQ ID NO: 3796
  source 1..203: mol_type = other DNA

SEQ ID NO: 29921 - DNA, 203 bp, Homo sapiens; identical to SEQ ID NO: 3797
  source 1..203: mol_type = other DNA

SEQ ID NO: 29922 - DNA, 203 bp, Homo sapiens; identical to SEQ ID NO: 3798
  source 1..203: mol_type = other DNA

SEQ ID NO: 29923 - DNA, 203 bp, Homo sapiens; identical to SEQ ID NO: 3799
  source 1..203: mol_type = other DNA

SEQ ID NO: 29924 - DNA, 203 bp, Homo sapiens; identical to SEQ ID NO: 3800
  source 1..203: mol_type = other DNA

SEQ ID NO: 29925 - DNA, 203 bp, Homo sapiens; identical to SEQ ID NO: 3801
  source 1..203: mol_type = other DNA

SEQ ID NO: 29926 - DNA, 203 bp, Homo sapiens; identical to SEQ ID NO: 3804
  source 1..203: mol_type = other DNA

SEQ ID NO: 29927 - DNA, 203 bp, Homo sapiens; identical to SEQ ID NO: 3806
  source 1..203: mol_type = other DNA

SEQ ID NO: 29928 - DNA, 203 bp, Homo sapiens; identical to SEQ ID NO: 3807
  source 1..203: mol_type = other DNA

SEQ ID NO: 29929 - DNA, 203 bp, Homo sapiens; identical to SEQ ID NO: 3808
  source 1..203: mol_type = other DNA

SEQ ID NO: 29930 - DNA, 203 bp, Homo sapiens; identical to SEQ ID NO: 3809
  source 1..203: mol_type = other DNA

SEQ ID NO: 29931 - DNA, 203 bp, Homo sapiens; identical to SEQ ID NO: 3811
  source 1..203: mol_type = other DNA

SEQ ID NO: 29932 - DNA, 203 bp, Homo sapiens; identical to SEQ ID NO: 3812
  source 1..203: mol_type = other DNA

SEQ ID NO: 29933 - DNA, 203 bp, Homo sapiens; identical to SEQ ID NO: 3813
  source 1..203: mol_type = other DNA

SEQ ID NO: 29934 - DNA, 203 bp, Homo sapiens; identical to SEQ ID NO: 3814
  source 1..203: mol_type = other DNA

SEQ ID NO: 29935 - DNA, 203 bp, Homo sapiens; identical to SEQ ID NO: 3826
  source 1..203: mol_type = other DNA

SEQ ID NO: 29936 - DNA, 203 bp, Homo sapiens; identical to SEQ ID NO: 3827
  source 1..203: mol_type = other DNA

SEQ ID NO: 29937 - DNA, 203 bp, Homo sapiens; identical to SEQ ID NO: 3828
  source 1..203: mol_type = other DNA

SEQ ID NO: 29938 - DNA, 203 bp, Homo sapiens; identical to SEQ ID NO: 3831
  source 1..203: mol_type = other DNA

SEQ ID NO: 29939 - DNA, 203 bp, Homo sapiens; identical to SEQ ID NO: 3836
  source 1..203: mol_type = other DNA

SEQ ID NO: 29940 - DNA, 203 bp, Homo sapiens; identical to SEQ ID NO: 3837
  source 1..203: mol_type = other DNA

SEQ ID NO: 29941 - DNA, 203 bp, Homo sapiens; identical to SEQ ID NO: 3839
  source 1..203: mol_type = other DNA

SEQ ID NO: 29942 - DNA, 203 bp, Homo sapiens; identical to SEQ ID NO: 3846
  source 1..203: mol_type = other DNA

SEQ ID NO: 29943 - DNA, 203 bp, Homo sapiens; identical to SEQ ID NO: 3847
  source 1..203: mol_type = other DNA

SEQ ID NO: 29944 - DNA, 203 bp, Homo sapiens; identical to SEQ ID NO: 3851
  source 1..203: mol_type = other DNA

SEQ ID NO: 29945 - DNA, 203 bp, Homo sapiens; identical to SEQ ID NO: 3852
  source 1..203: mol_type = other DNA

SEQ ID NO: 29946 - DNA, 203 bp, Homo sapiens; identical to SEQ ID NO: 3853
  source 1..203: mol_type = other DNA

SEQ ID NO: 29947 - DNA, 203 bp, Homo sapiens; identical to SEQ ID NO: 3856
  source 1..203: mol_type = other DNA

SEQ ID NO: 29948 - DNA, 203 bp, Homo sapiens; identical to SEQ ID NO: 3861
  source 1..203: mol_type = other DNA

SEQ ID NO: 29949 - DNA, 203 bp, Homo sapiens; identical to SEQ ID NO: 3862
  source 1..203: mol_type = other DNA

SEQ ID NO: 29950 - DNA, 203 bp, Homo sapiens; identical to SEQ ID NO: 3871
  source 1..203: mol_type = other DNA

SEQ ID NO: 29951 - DNA, 203 bp, Homo sapiens; identical to SEQ ID NO: 3872
  source 1..203: mol_type = other DNA

SEQ ID NO: 29952 - DNA, 203 bp, Homo sapiens; identical to SEQ ID NO: 3874
  source 1..203: mol_type = other DNA

SEQ ID NO: 29953 - DNA, 203 bp, Homo sapiens; identical to SEQ ID NO: 3875
  source 1..203: mol_type = other DNA

SEQ ID NO: 29954 - DNA, 203 bp, Homo sapiens; identical to SEQ ID NO: 3876
  source 1..203: mol_type = other DNA

SEQ ID NO: 29955 - DNA, 203 bp, Homo sapiens; identical to SEQ ID NO: 3877
  source 1..203: mol_type = other DNA

SEQ ID NO: 29956 - DNA, 203 bp, Homo sapiens; identical to SEQ ID NO: 3880
  source 1..203: mol_type = other DNA

SEQ ID NO: 29957 - DNA, 203 bp, Homo sapiens; identical to SEQ ID NO: 3881
  source 1..203: mol_type = other DNA

SEQ ID NO: 29958 - DNA, 203 bp, Homo sapiens; identical to SEQ ID NO: 3883
  source 1..203: mol_type = other DNA

SEQ ID NO: 29959 - DNA, 203 bp, Homo sapiens; identical to SEQ ID NO: 3886
  source 1..203: mol_type = other DNA

SEQ ID NO: 29960 - DNA, 203 bp, Homo sapiens; identical to SEQ ID NO: 3887
  source 1..203: mol_type = other DNA

SEQ ID NO: 29961 - DNA, 203 bp, Homo sapiens; identical to SEQ ID NO: 3888
  source 1..203: mol_type = other DNA

SEQ ID NO: 29962 - DNA, 203 bp, Homo sapiens; identical to SEQ ID NO: 3889
  source 1..203: mol_type = other DNA

SEQ ID NO: 29963 - DNA, 203 bp, Homo sapiens; identical to SEQ ID NO: 3894
  source 1..203: mol_type = other DNA

SEQ ID NO: 29964 - DNA, 203 bp, Homo sapiens; identical to SEQ ID NO: 3896
  source 1..203: mol_type = other DNA

SEQ ID NO: 29965 - DNA, 203 bp, Homo sapiens; identical to SEQ ID NO: 3897
  source 1..203: mol_type = other DNA

SEQ ID NO: 29966 - DNA, 203 bp, Homo sapiens; identical to SEQ ID NO: 3908
  source 1..203: mol_type = other DNA

SEQ ID NO: 29967 - DNA, 203 bp, Homo sapiens; identical to SEQ ID NO: 3909
  source 1..203: mol_type = other DNA

SEQ ID NO: 29968 - DNA, 203 bp, Homo sapiens; identical to SEQ ID NO: 3914
  source 1..203: mol_type = other DNA

SEQ ID NO: 29969 - DNA, 203 bp, Homo sapiens; identical to SEQ ID NO: 3915
  source 1..203: mol_type = other DNA

SEQ ID NO: 29970 - DNA, 203 bp, Homo sapiens; identical to SEQ ID NO: 3926
  source 1..203: mol_type = other DNA

SEQ ID NO: 29971 - DNA, 203 bp, Homo sapiens; identical to SEQ ID NO: 3929
  source 1..203: mol_type = other DNA

SEQ ID NO: 29972 - DNA, 203 bp, Homo sapiens; identical to SEQ ID NO: 3931
  source 1..203: mol_type = other DNA

SEQ ID NO: 29973 - DNA, 203 bp, Homo sapiens; identical to SEQ ID NO: 3933
  source 1..203: mol_type = other DNA

SEQ ID NO: 29974 - DNA, 203 bp, Homo sapiens; identical to SEQ ID NO: 3934
  source 1..203: mol_type = other DNA

SEQ ID NO: 29975 - DNA, 203 bp, Homo sapiens; identical to SEQ ID NO: 3937
  source 1..203: mol_type = other DNA

SEQ ID NO: 29976 - DNA, 203 bp, Homo sapiens; identical to SEQ ID NO: 3949
  source 1..203: mol_type = other DNA

SEQ ID NO: 29977 - DNA, 203 bp, Homo sapiens; identical to SEQ ID NO: 3958
  source 1..203: mol_type = other DNA

SEQ ID NO: 29978 - DNA, 203 bp, Homo sapiens; identical to SEQ ID NO: 3967
  source 1..203: mol_type = other DNA

SEQ ID NO: 29979 - DNA, 203 bp, Homo sapiens; identical to SEQ ID NO: 3969
  source 1..203: mol_type = other DNA

SEQ ID NO: 29980 - DNA, 203 bp, Homo sapiens; identical to SEQ ID NO: 3970
  source 1..203: mol_type = other DNA

SEQ ID NO: 29981 - DNA, 203 bp, Homo sapiens; identical to SEQ ID NO: 3972
  source 1..203: mol_type = other DNA

SEQ ID NO: 29982 - DNA, 203 bp, Homo sapiens; identical to SEQ ID NO: 3976
  source 1..203: mol_type = other DNA

SEQ ID NO: 29983 - DNA, 203 bp, Homo sapiens; identical to SEQ ID NO: 3977
  source 1..203: mol_type = other DNA

SEQ ID NO: 29984 - DNA, 203 bp, Homo sapiens; identical to SEQ ID NO: 3980
  source 1..203: mol_type = other DNA

SEQ ID NO: 29985 - DNA, 203 bp, Homo sapiens; identical to SEQ ID NO: 3989
  source 1..203: mol_type = other DNA

SEQ ID NO: 29986 - DNA, 203 bp, Homo sapiens; identical to SEQ ID NO: 3990
  source 1..203: mol_type = other DNA

SEQ ID NO: 29987 - DNA, 203 bp, Homo sapiens; identical to SEQ ID NO: 3992
  source 1..203: mol_type = other DNA

SEQ ID NO: 29988 - DNA, 203 bp, Homo sapiens; identical to SEQ ID NO: 3993
  source 1..203: mol_type = other DNA

SEQ ID NO: 29989 - DNA, 203 bp, Homo sapiens; identical to SEQ ID NO: 4006
  source 1..203: mol_type = other DNA

SEQ ID NO: 29990 - DNA, 203 bp, Homo sapiens; identical to SEQ ID NO: 4008
  source 1..203: mol_type = other DNA

SEQ ID NO: 29991 - DNA, 203 bp, Homo sapiens; identical to SEQ ID NO: 4017
  source 1..203: mol_type = other DNA

SEQ ID NO: 29992 - DNA, 203 bp, Homo sapiens; identical to SEQ ID NO: 4021
  source 1..203: mol_type = other DNA

SEQ ID NO: 29993 - DNA, 203 bp, Homo sapiens; identical to SEQ ID NO: 4022
  source 1..203: mol_type = other DNA

SEQ ID NO: 29994 - DNA, 203 bp, Homo sapiens; identical to SEQ ID NO: 4023
  source 1..203: mol_type = other DNA

SEQ ID NO: 29995 - DNA, 203 bp, Homo sapiens; identical to SEQ ID NO: 4030
  source 1..203: mol_type = other DNA

SEQ ID NO: 29996 - DNA, 203 bp, Homo sapiens; identical to SEQ ID NO: 4041
  source 1..203: mol_type = other DNA

SEQ ID NO: 29997 - DNA, 203 bp, Homo sapiens; identical to SEQ ID NO: 4057
  source 1..203: mol_type = other DNA

SEQ ID NO: 29998 - DNA, 203 bp, Homo sapiens; identical to SEQ ID NO: 4059
  source 1..203: mol_type = other DNA

SEQ ID NO: 29999 - DNA, 203 bp, Homo sapiens; identical to SEQ ID NO: 4065
  source 1..203: mol_type = other DNA

SEQ ID NO: 30000 - DNA, 203 bp, Homo sapiens; identical to SEQ ID NO: 4068
  source 1..203: mol_type = other DNA

SEQ ID NO: 30001 - DNA, 203 bp, Homo sapiens; identical to SEQ ID NO: 4069
  source 1..203: mol_type = other DNA

SEQ ID NO: 30002 - DNA, 203 bp, Homo sapiens; identical to SEQ ID NO: 4087
  source 1..203: mol_type = other DNA

SEQ ID NO: 30003 - DNA, 203 bp, Homo sapiens; identical to SEQ ID NO: 4093
  source 1..203: mol_type = other DNA

SEQ ID NO: 30004 - DNA, 203 bp, Homo sapiens; identical to SEQ ID NO: 4097
  source 1..203: mol_type = other DNA

SEQ ID NO: 30005 - DNA, 203 bp, Homo sapiens; identical to SEQ ID NO: 4101
  source 1..203: mol_type = other DNA

SEQ ID NO: 30006 - DNA, 203 bp, Homo sapiens; identical to SEQ ID NO: 4108
  source 1..203: mol_type = other DNA

SEQ ID NO: 30007 - DNA, 203 bp, Homo sapiens; identical to SEQ ID NO: 4109
  source 1..203: mol_type = other DNA

SEQ ID NO: 30008 - DNA, 203 bp, Homo sapiens; identical to SEQ ID NO: 4113
  source 1..203: mol_type = other DNA

SEQ ID NO: 30009 - DNA, 203 bp, Homo sapiens; identical to SEQ ID NO: 4115
  source 1..203: mol_type = other DNA

SEQ ID NO: 30010 - DNA, 203 bp, Homo sapiens; identical to SEQ ID NO: 4116
  source 1..203: mol_type = other DNA

SEQ ID NO: 30011 - DNA, 203 bp, Homo sapiens; identical to SEQ ID NO: 4127
  source 1..203: mol_type = other DNA

SEQ ID NO: 30012 - DNA, 203 bp, Homo sapiens; identical to SEQ ID NO: 4131
  source 1..203: mol_type = other DNA

SEQ ID NO: 30013 - DNA, 203 bp, Homo sapiens; identical to SEQ ID NO: 4149
  source 1..203: mol_type = other DNA

SEQ ID NO: 30014 - DNA, 203 bp, Homo sapiens; identical to SEQ ID NO: 4151
  source 1..203: mol_type = other DNA

SEQ ID NO: 30015 - DNA, 203 bp, Homo sapiens; identical to SEQ ID NO: 4152
  source 1..203: mol_type = other DNA

SEQ ID NO: 30016 - DNA, 203 bp, Homo sapiens; identical to SEQ ID NO: 4155
  source 1..203: mol_type = other DNA

SEQ ID NO: 30017 - DNA, 203 bp, Homo sapiens; identical to SEQ ID NO: 4156
  source 1..203: mol_type = other DNA

SEQ ID NO: 30018 - DNA, 203 bp, Homo sapiens; identical to SEQ ID NO: 4157
  source 1..203: mol_type = other DNA

SEQ ID NO: 30019 - DNA, 203 bp, Homo sapiens; identical to SEQ ID NO: 4164
  source 1..203: mol_type = other DNA

SEQ ID NO: 30020 - DNA, 203 bp, Homo sapiens; identical to SEQ ID NO: 4169
  source 1..203: mol_type = other DNA

SEQ ID NO: 30021 - DNA, 203 bp, Homo sapiens; identical to SEQ ID NO: 4171
  source 1..203: mol_type = other DNA

SEQ ID NO: 30022 - DNA, 203 bp, Homo sapiens; identical to SEQ ID NO: 4172
  source 1..203: mol_type = other DNA

SEQ ID NO: 30023 - DNA, 203 bp, Homo sapiens; identical to SEQ ID NO: 4176
  source 1..203: mol_type = other DNA

SEQ ID NO: 30024 - DNA, 203 bp, Homo sapiens; identical to SEQ ID NO: 4179
  source 1..203: mol_type = other DNA

SEQ ID NO: 30025 - DNA, 203 bp, Homo sapiens; identical to SEQ ID NO: 4189
  source 1..203: mol_type = other DNA

SEQ ID NO: 30026 - DNA, 203 bp, Homo sapiens; identical to SEQ ID NO: 4190
  source 1..203: mol_type = other DNA

SEQ ID NO: 30027 - DNA, 203 bp, Homo sapiens; identical to SEQ ID NO: 4205
  source 1..203: mol_type = other DNA

SEQ ID NO: 30028 - DNA, 203 bp, Homo sapiens; identical to SEQ ID NO: 4210
  source 1..203: mol_type = other DNA

SEQ ID NO: 30029 - DNA, 203 bp, Homo sapiens; identical to SEQ ID NO: 4211
  source 1..203: mol_type = other DNA

SEQ ID NO: 30030 - DNA, 203 bp, Homo sapiens; identical to SEQ ID NO: 4234
  source 1..203: mol_type = other DNA

SEQ ID NO: 30031 - DNA, 203 bp, Homo sapiens; identical to SEQ ID NO: 4237
  source 1..203: mol_type = other DNA

SEQ ID NO: 30032 - DNA, 203 bp, Homo sapiens; identical to SEQ ID NO: 4245
  source 1..203: mol_type = other DNA

SEQ ID NO: 30033 - DNA, 203 bp, Homo sapiens; identical to SEQ ID NO: 4262
  source 1..203: mol_type = other DNA

SEQ ID NO: 30034 - DNA, 203 bp, Homo sapiens; identical to SEQ ID NO: 4264
  source 1..203: mol_type = other DNA

SEQ ID NO: 30035 - DNA, 203 bp, Homo sapiens; identical to SEQ ID NO: 4265
  source 1..203: mol_type = other DNA

SEQ ID NO: 30036 - DNA, 203 bp, Homo sapiens; identical to SEQ ID NO: 4269
  source 1..203: mol_type = other DNA

SEQ ID NO: 30037 - DNA, 203 bp, Homo sapiens; identical to SEQ ID NO: 4272
  source 1..203: mol_type = other DNA

SEQ ID NO: 30038 - DNA, 203 bp, Homo sapiens; identical to SEQ ID NO: 4306
  source 1..203: mol_type = other DNA

SEQ ID NO: 30039 - DNA, 203 bp, Homo sapiens; identical to SEQ ID NO: 4311
  source 1..203: mol_type = other DNA

SEQ ID NO: 30040 - DNA, 203 bp, Homo sapiens; identical to SEQ ID NO: 4315
  source 1..203: mol_type = other DNA

SEQ ID NO: 30041 - DNA, 203 bp, Homo sapiens; identical to SEQ ID NO: 4325
  source 1..203: mol_type = other DNA

SEQ ID NO: 30042 - DNA, 203 bp, Homo sapiens; identical to SEQ ID NO: 4328
  source 1..203: mol_type = other DNA

SEQ ID NO: 30043 - DNA, 203 bp, Homo sapiens; identical to SEQ ID NO: 4329
  source 1..203: mol_type = other DNA

SEQ ID NO: 30044 - DNA, 203 bp, Homo sapiens; identical to SEQ ID NO: 4333
  source 1..203: mol_type = other DNA

SEQ ID NO: 30045 - DNA, 203 bp, Homo sapiens; identical to SEQ ID NO: 4334
  source 1..203: mol_type = other DNA

SEQ ID NO: 30046 - DNA, 203 bp, Homo sapiens; identical to SEQ ID NO: 4337
  source 1..203: mol_type = other DNA

SEQ ID NO: 30047 - DNA, 203 bp, Homo sapiens; identical to SEQ ID NO: 4348
  source 1..203: mol_type = other DNA

SEQ ID NO: 30048 - DNA, 203 bp, Homo sapiens; identical to SEQ ID NO: 4351
  source 1..203: mol_type = other DNA

SEQ ID NO: 30049 - DNA, 203 bp, Homo sapiens; identical to SEQ ID NO: 4352
  source 1..203: mol_type = other DNA

SEQ ID NO: 30050 - DNA, 203 bp, Homo sapiens; identical to SEQ ID NO: 4363
  source 1..203: mol_type = other DNA

SEQ ID NO: 30051 - DNA, 203 bp, Homo sapiens; identical to SEQ ID NO: 4366
  source 1..203: mol_type = other DNA

SEQ ID NO: 30052 - DNA, 203 bp, Homo sapiens; identical to SEQ ID NO: 4373
  source 1..203: mol_type = other DNA

SEQ ID NO: 30053 - DNA, 203 bp, Homo sapiens; identical to SEQ ID NO: 4377
  source 1..203: mol_type = other DNA

SEQ ID NO: 30054 - DNA, 203 bp, Homo sapiens; identical to SEQ ID NO: 4379
  source 1..203: mol_type = other DNA

SEQ ID NO: 30055 - DNA, 203 bp, Homo sapiens; identical to SEQ ID NO: 4385
  source 1..203: mol_type = other DNA

SEQ ID NO: 30056 - DNA, 203 bp, Homo sapiens; identical to SEQ ID NO: 4390
  source 1..203: mol_type = other DNA

SEQ ID NO: 30057 - DNA, 203 bp, Homo sapiens; identical to SEQ ID NO: 4405
  source 1..203: mol_type = other DNA

SEQ ID NO: 30058 - DNA, 203 bp, Homo sapiens; identical to SEQ ID NO: 4411
  source 1..203: mol_type = other DNA

SEQ ID NO: 30059 - DNA, 203 bp, Homo sapiens; identical to SEQ ID NO: 4412
  source 1..203: mol_type = other DNA

SEQ ID NO: 30060 - DNA, 203 bp, Homo sapiens; identical to SEQ ID NO: 4418
  source 1..203: mol_type = other DNA

SEQ ID NO: 30061 - DNA, 203 bp, Homo sapiens; identical to SEQ ID NO: 4422
  source 1..203: mol_type = other DNA

SEQ ID NO: 30062 - DNA, 203 bp, Homo sapiens; identical to SEQ ID NO: 4425
  source 1..203: mol_type = other DNA

SEQ ID NO: 30063 - DNA, 203 bp, Homo sapiens; identical to SEQ ID NO: 4454
  source 1..203: mol_type = other DNA

SEQ ID NO: 30064 - DNA, 203 bp, Homo sapiens; identical to SEQ ID NO: 4461
  source 1..203: mol_type = other DNA

SEQ ID NO: 30065 - DNA, 203 bp, Homo sapiens; identical to SEQ ID NO: 4473
  source 1..203: mol_type = other DNA

SEQ ID NO: 30066 - DNA, 203 bp, Homo sapiens; identical to SEQ ID NO: 4476
  source 1..203: mol_type = other DNA

SEQ ID NO: 30067 - DNA, 203 bp, Homo sapiens; identical to SEQ ID NO: 4477
  source 1..203: mol_type = other DNA

SEQ ID NO: 30068 - DNA, 203 bp, Homo sapiens; identical to SEQ ID NO: 4482
  source 1..203: mol_type = other DNA

SEQ ID NO: 30069 - DNA, 203 bp, Homo sapiens; identical to SEQ ID NO: 4491
  source 1..203: mol_type = other DNA

SEQ ID NO: 30070 - DNA, 203 bp, Homo sapiens; identical to SEQ ID NO: 4492
  source 1..203: mol_type = other DNA

SEQ ID NO: 30071 - DNA, 203 bp, Homo sapiens; identical to SEQ ID NO: 4496
  source 1..203: mol_type = other DNA

SEQ ID NO: 30072 - DNA, 203 bp, Homo sapiens; identical to SEQ ID NO: 4502
  source 1..203: mol_type = other DNA

SEQ ID NO: 30073 - DNA, 203 bp, Homo sapiens; identical to SEQ ID NO: 4514
  source 1..203: mol_type = other DNA

SEQ ID NO: 30074 - DNA, 203 bp, Homo sapiens; identical to SEQ ID NO: 4517
  source 1..203: mol_type = other DNA

SEQ ID NO: 30075 - DNA, 203 bp, Homo sapiens; identical to SEQ ID NO: 4518
  source 1..203: mol_type = other DNA

SEQ ID NO: 30076 - DNA, 203 bp, Homo sapiens; identical to SEQ ID NO: 4519
  source 1..203: mol_type = other DNA

SEQ ID NO: 30077 - DNA, 203 bp, Homo sapiens; identical to SEQ ID NO: 4520
  source 1..203: mol_type = other DNA

SEQ ID NO: 30078 - DNA, 203 bp, Homo sapiens; identical to SEQ ID NO: 4521
  source 1..203: mol_type = other DNA

SEQ ID NO: 30079 - DNA, 203 bp, Homo sapiens; identical to SEQ ID NO: 4522
  source 1..203: mol_type = other DNA

SEQ ID NO: 30080 - DNA, 203 bp, Homo sapiens; identical to SEQ ID NO: 4523
  source 1..203: mol_type = other DNA

SEQ ID NO: 30081 - DNA, 203 bp, Homo sapiens; identical to SEQ ID NO: 4524
  source 1..203: mol_type = other DNA

SEQ ID NO: 30082 - DNA, 203 bp, Homo sapiens; identical to SEQ ID NO: 4525
  source 1..203: mol_type = other DNA

SEQ ID NO: 30083 - DNA, 203 bp, Homo sapiens; identical to SEQ ID NO: 4526
  source 1..203: mol_type = other DNA

SEQ ID NO: 30084 - DNA, 203 bp, Homo sapiens; identical to SEQ ID NO: 4527
  source 1..203: mol_type = other DNA

SEQ ID NO: 30085 - DNA, 203 bp, Homo sapiens; identical to SEQ ID NO: 4528
  source 1..203: mol_type = other DNA

SEQ ID NO: 30086 - DNA, 203 bp, Homo sapiens; identical to SEQ ID NO: 4529
  source 1..203: mol_type = other DNA

SEQ ID NO: 30087 - DNA, 203 bp, Homo sapiens; identical to SEQ ID NO: 4530
  source 1..203: mol_type = other DNA

SEQ ID NO: 30088 - DNA, 203 bp, Homo sapiens; identical to SEQ ID NO: 4531
  source 1..203: mol_type = other DNA

SEQ ID NO: 30089 - DNA, 203 bp, Homo sapiens; identical to SEQ ID NO: 4532
  source 1..203: mol_type = other DNA

SEQ ID NO: 30090 - DNA, 203 bp, Homo sapiens; identical to SEQ ID NO: 4533
  source 1..203: mol_type = other DNA

SEQ ID NO: 30091 - DNA, 203 bp, Homo sapiens; identical to SEQ ID NO: 4534
  source 1..203: mol_type = other DNA

SEQ ID NO: 30092 - DNA, 203 bp, Homo sapiens; identical to SEQ ID NO: 4572
  source 1..203: mol_type = other DNA

SEQ ID NO: 30093 - DNA, 203 bp, Homo sapiens; identical to SEQ ID NO: 4628
  source 1..203: mol_type = other DNA

SEQ ID NO: 30094 - DNA, 203 bp, Homo sapiens; identical to SEQ ID NO: 4629
  source 1..203: mol_type = other DNA

SEQ ID NO: 30095 - DNA, 203 bp, Homo sapiens; identical to SEQ ID NO: 4634
  source 1..203: mol_type = other DNA

SEQ ID NO: 30096 - DNA, 203 bp, Homo sapiens; identical to SEQ ID NO: 4637
  source 1..203: mol_type = other DNA

SEQ ID NO: 30097 - DNA, 203 bp, Homo sapiens; identical to SEQ ID NO: 4644
  source 1..203: mol_type = other DNA

SEQ ID NO: 30098 - DNA, 203 bp, Homo sapiens; identical to SEQ ID NO: 4650
  source 1..203: mol_type = other DNA

SEQ ID NO: 30099 - DNA, 203 bp, Homo sapiens; identical to SEQ ID NO: 4655
  source 1..203: mol_type = other DNA

SEQ ID NO: 30100 - DNA, 203 bp, Homo sapiens; identical to SEQ ID NO: 4659
  source 1..203: mol_type = other DNA

SEQ ID NO: 30101 - DNA, 203 bp, Homo sapiens; identical to SEQ ID NO: 4690
  source 1..203: mol_type = other DNA

SEQ ID NO: 30102 - DNA, 203 bp, Homo sapiens; identical to SEQ ID NO: 4691
  source 1..203: mol_type = other DNA

SEQ ID NO: 30103 - DNA, 203 bp, Homo sapiens; identical to SEQ ID NO: 4692
  source 1..203: mol_type = other DNA

SEQ ID NO: 30104 - DNA, 203 bp, Homo sapiens; identical to SEQ ID NO: 4693
  source 1..203: mol_type = other DNA

SEQ ID NO: 30105 - DNA, 203 bp, Homo sapiens; identical to SEQ ID NO: 4694
  source 1..203: mol_type = other DNA

SEQ ID NO: 30106 - DNA, 203 bp, Homo sapiens; identical to SEQ ID NO: 4695
  source 1..203: mol_type = other DNA

SEQ ID NO: 30107 - DNA, 203 bp, Homo sapiens; identical to SEQ ID NO: 4696
  source 1..203: mol_type = other DNA

SEQ ID NO: 30108 - DNA, 203 bp, Homo sapiens; identical to SEQ ID NO: 4697
  source 1..203: mol_type = other DNA

SEQ ID NO: 30109 - DNA, 203 bp, Homo sapiens; identical to SEQ ID NO: 4698
  source 1..203: mol_type = other DNA

SEQ ID NO: 30110 - DNA, 203 bp, Homo sapiens; identical to SEQ ID NO: 4699
  source 1..203: mol_type = other DNA

SEQ ID NO: 30111 - DNA, 203 bp, Homo sapiens; identical to SEQ ID NO: 4700
  source 1..203: mol_type = other DNA

SEQ ID NO: 30112 - DNA, 203 bp, Homo sapiens; identical to SEQ ID NO: 4707
  source 1..203: mol_type = other DNA

SEQ ID NO: 30113 - DNA, 203 bp, Homo sapiens; identical to SEQ ID NO: 4708
  source 1..203: mol_type = other DNA

SEQ ID NO: 30114 - DNA, 203 bp, Homo sapiens; identical to SEQ ID NO: 4709
  source 1..203: mol_type = other DNA

SEQ ID NO: 30115 - DNA, 203 bp, Homo sapiens; identical to SEQ ID NO: 4710
  source 1..203: mol_type = other DNA

SEQ ID NO: 30116 - DNA, 203 bp, Homo sapiens; identical to SEQ ID NO: 4711
  source 1..203: mol_type = other DNA

SEQ ID NO: 30117 - DNA, 203 bp, Homo sapiens; identical to SEQ ID NO: 4712
  source 1..203: mol_type = other DNA

SEQ ID NO: 30118 - DNA, 203 bp, Homo sapiens; identical to SEQ ID NO: 4719
  source 1..203: mol_type = other DNA

SEQ ID NO: 30119 - DNA, 203 bp, Homo sapiens; identical to SEQ ID NO: 4720
  source 1..203: mol_type = other DNA

SEQ ID NO: 30120 - DNA, 203 bp, Homo sapiens; identical to SEQ ID NO: 4721
  source 1..203: mol_type = other DNA

SEQ ID NO: 30121 - DNA, 203 bp, Homo sapiens; identical to SEQ ID NO: 4722
  source 1..203: mol_type = other DNA

SEQ ID NO: 30122 - DNA, 203 bp, Homo sapiens; identical to SEQ ID NO: 4732
  source 1..203: mol_type = other DNA

SEQ ID NO: 30123 - DNA, 203 bp, Homo sapiens; identical to SEQ ID NO: 4741
  source 1..203: mol_type = other DNA

SEQ ID NO: 30124 - DNA, 203 bp, Homo sapiens; identical to SEQ ID NO: 4743
  source 1..203: mol_type = other DNA

SEQ ID NO: 30125 - DNA, 203 bp, Homo sapiens; identical to SEQ ID NO: 4749
  source 1..203: mol_type = other DNA

SEQ ID NO: 30126 - DNA, 203 bp, Homo sapiens; identical to SEQ ID NO: 4750
  source 1..203: mol_type = other DNA

SEQ ID NO: 30127 - DNA, 203 bp, Homo sapiens; identical to SEQ ID NO: 4751
  source 1..203: mol_type = other DNA

SEQ ID NO: 30128 - DNA, 203 bp, Homo sapiens; identical to SEQ ID NO: 4752
  source 1..203: mol_type = other DNA

SEQ ID NO: 30129 - DNA, 203 bp, Homo sapiens; identical to SEQ ID NO: 4758
  source 1..203: mol_type = other DNA

SEQ ID NO: 30130 - DNA, 203 bp, Homo sapiens; identical to SEQ ID NO: 4759
  source 1..203: mol_type = other DNA

SEQ ID NO: 30131 - DNA, 203 bp, Homo sapiens; identical to SEQ ID NO: 4760
  source 1..203: mol_type = other DNA

SEQ ID NO: 30132 - DNA, 203 bp, Homo sapiens; identical to SEQ ID NO: 4761
  source 1..203: mol_type = other DNA

SEQ ID NO: 30133 - DNA, 203 bp, Homo sapiens; identical to SEQ ID NO: 4762
  source 1..203: mol_type = other DNA

SEQ ID NO: 30134 - DNA, 203 bp, Homo sapiens; identical to SEQ ID NO: 4763
  source 1..203: mol_type = other DNA

SEQ ID NO: 30135 - DNA, 203 bp, Homo sapiens; identical to SEQ ID NO: 4771
  source 1..203: mol_type = other DNA

SEQ ID NO: 30136 - DNA, 203 bp, Homo sapiens; identical to SEQ ID NO: 4772
  source 1..203: mol_type = other DNA

SEQ ID NO: 30137 - DNA, 203 bp, Homo sapiens; identical to SEQ ID NO: 4773
  source 1..203: mol_type = other DNA

SEQ ID NO: 30138 - DNA, 203 bp, Homo sapiens; identical to SEQ ID NO: 4774
  source 1..203: mol_type = other DNA

SEQ ID NO: 30139 - DNA, 203 bp, Homo sapiens; identical to SEQ ID NO: 4775
  source 1..203: mol_type = other DNA

SEQ ID NO: 30140 - DNA, 203 bp, Homo sapiens; identical to SEQ ID NO: 4778
  source 1..203: mol_type = other DNA

SEQ ID NO: 30141 - DNA, 203 bp, Homo sapiens; identical to SEQ ID NO: 4789
  source 1..203: mol_type = other DNA

SEQ ID NO: 30142 - DNA, 203 bp, Homo sapiens; identical to SEQ ID NO: 4790
  source 1..203: mol_type = other DNA

SEQ ID NO: 30143 - DNA, 203 bp, Homo sapiens; identical to SEQ ID NO: 4803
  source 1..203: mol_type = other DNA

SEQ ID NO: 30144 - DNA, 203 bp, Homo sapiens; identical to SEQ ID NO: 4804
  source 1..203: mol_type = other DNA

SEQ ID NO: 30145 - DNA, 203 bp, Homo sapiens; identical to SEQ ID NO: 4813
  source 1..203: mol_type = other DNA

SEQ ID NO: 30146 - DNA, 203 bp, Homo sapiens; identical to SEQ ID NO: 4814
  source 1..203: mol_type = other DNA

SEQ ID NO: 30147 - DNA, 203 bp, Homo sapiens; identical to SEQ ID NO: 4815
  source 1..203: mol_type = other DNA

SEQ ID NO: 30148 - DNA, 203 bp, Homo sapiens; identical to SEQ ID NO: 4816
  source 1..203: mol_type = other DNA

SEQ ID NO: 30149 - DNA, 203 bp, Homo sapiens; identical to SEQ ID NO: 4817
  source 1..203: mol_type = other DNA

SEQ ID NO: 30150 - DNA, 203 bp, Homo sapiens; identical to SEQ ID NO: 4819
  source 1..203: mol_type = other DNA

SEQ ID NO: 30151 - DNA, 203 bp, Homo sapiens; identical to SEQ ID NO: 4828
  source 1..203: mol_type = other DNA

SEQ ID NO: 30152 - DNA, 203 bp, Homo sapiens; identical to SEQ ID NO: 4829
  source 1..203: mol_type = other DNA

SEQ ID NO: 30153 - DNA, 203 bp, Homo sapiens; identical to SEQ ID NO: 4830
  source 1..203: mol_type = other DNA

SEQ ID NO: 30154 - DNA, 203 bp, Homo sapiens; identical to SEQ ID NO: 4831
  source 1..203: mol_type = other DNA

SEQ ID NO: 30155 - DNA, 203 bp, Homo sapiens; identical to SEQ ID NO: 4832
  source 1..203: mol_type = other DNA

SEQ ID NO: 30156 - DNA, 203 bp, Homo sapiens; identical to SEQ ID NO: 4833
  source 1..203: mol_type = other DNA

SEQ ID NO: 30157 - DNA, 203 bp, Homo sapiens; identical to SEQ ID NO: 4834
  source 1..203: mol_type = other DNA

SEQ ID NO: 30158 - DNA, 203 bp, Homo sapiens; identical to SEQ ID NO: 4835
  source 1..203: mol_type = other DNA

SEQ ID NO: 30159 - DNA, 203 bp, Homo sapiens; identical to SEQ ID NO: 4836
  source 1..203: mol_type = other DNA

SEQ ID NO: 30160 - DNA, 203 bp, Homo sapiens; identical to SEQ ID NO: 4837
  source 1..203: mol_type = other DNA

SEQ ID NO: 30161 - DNA, 203 bp, Homo sapiens; identical to SEQ ID NO: 4838
  source 1..203: mol_type = other DNA

SEQ ID NO: 30162 - DNA, 203 bp, Homo sapiens; identical to SEQ ID NO: 4839
  source 1..203: mol_type = other DNA

SEQ ID NO: 30163 - DNA, 203 bp, Homo sapiens; identical to SEQ ID NO: 4840
  source 1..203: mol_type = other DNA

SEQ ID NO: 30164 - DNA, 203 bp, Homo sapiens; identical to SEQ ID NO: 4841
  source 1..203: mol_type = other DNA

SEQ ID NO: 30165 - DNA, 203 bp, Homo sapiens; identical to SEQ ID NO: 4842
  source 1..203: mol_type = other DNA

SEQ ID NO: 30166 - DNA, 203 bp, Homo sapiens; identical to SEQ ID NO: 4843
  source 1..203: mol_type = other DNA

SEQ ID NO: 30167 - DNA, 203 bp, Homo sapiens; identical to SEQ ID NO: 4844
  source 1..203: mol_type = other DNA

SEQ ID NO: 30168 - DNA, 203 bp, Homo sapiens; identical to SEQ ID NO: 4845
  source 1..203: mol_type = other DNA

SEQ ID NO: 30169 - DNA, 203 bp, Homo sapiens; identical to SEQ ID NO: 4846
  source 1..203: mol_type = other DNA

SEQ ID NO: 30170 - DNA, 203 bp, Homo sapiens; identical to SEQ ID NO: 4847
  source 1..203: mol_type = other DNA

SEQ ID NO: 30171 - DNA, 203 bp, Homo sapiens; identical to SEQ ID NO: 4848
  source 1..203: mol_type = other DNA

SEQ ID NO: 30172 - DNA, 203 bp, Homo sapiens; identical to SEQ ID NO: 4849
  source 1..203: mol_type = other DNA

SEQ ID NO: 30173 - DNA, 203 bp, Homo sapiens; identical to SEQ ID NO: 4850
  source 1..203: mol_type = other DNA

SEQ ID NO: 30174 - DNA, 203 bp, Homo sapiens; identical to SEQ ID NO: 4851
  source 1..203: mol_type = other DNA

SEQ ID NO: 30175 - DNA, 203 bp, Homo sapiens; identical to SEQ ID NO: 4852
  source 1..203: mol_type = other DNA

SEQ ID NO: 30176 - DNA, 203 bp, Homo sapiens; identical to SEQ ID NO: 4862
  source 1..203: mol_type = other DNA

SEQ ID NO: 30177 - DNA, 203 bp, Homo sapiens; identical to SEQ ID NO: 4893
  source 1..203: mol_type = other DNA

SEQ ID NO: 30178 - DNA, 203 bp, Homo sapiens; identical to SEQ ID NO: 4903
  source 1..203: mol_type = other DNA

SEQ ID NO: 30179 - DNA, 203 bp, Homo sapiens; identical to SEQ ID NO: 4904
  source 1..203: mol_type = other DNA

SEQ ID NO: 30180 - DNA, 203 bp, Homo sapiens; identical to SEQ ID NO: 4905
  source 1..203: mol_type = other DNA

SEQ ID NO: 30181 - DNA, 203 bp, Homo sapiens; identical to SEQ ID NO: 4906
  source 1..203: mol_type = other DNA

SEQ ID NO: 30182 - DNA, 203 bp, Homo sapiens; identical to SEQ ID NO: 4907
  source 1..203: mol_type = other DNA

SEQ ID NO: 30183 - DNA, 203 bp, Homo sapiens; identical to SEQ ID NO: 4917
  source 1..203: mol_type = other DNA

SEQ ID NO: 30184 - DNA, 203 bp, Homo sapiens; identical to SEQ ID NO: 4932
  source 1..203: mol_type = other DNA

SEQ ID NO: 30185 - DNA, 203 bp, Homo sapiens; identical to SEQ ID NO: 4933
  source 1..203: mol_type = other DNA

SEQ ID NO: 30186 - DNA, 203 bp, Homo sapiens; identical to SEQ ID NO: 4934
  source 1..203: mol_type = other DNA

SEQ ID NO: 30187 - DNA, 203 bp, Homo sapiens; identical to SEQ ID NO: 4935
  source 1..203: mol_type = other DNA

SEQ ID NO: 30188 - DNA, 203 bp, Homo sapiens; identical to SEQ ID NO: 4937
  source 1..203: mol_type = other DNA

SEQ ID NO: 30189 - DNA, 203 bp, Homo sapiens; identical to SEQ ID NO: 4948
  source 1..203: mol_type = other DNA

SEQ ID NO: 30190 - DNA, 203 bp, Homo sapiens; identical to SEQ ID NO: 4949
  source 1..203: mol_type = other DNA

SEQ ID NO: 30191 - DNA, 203 bp, Homo sapiens; identical to SEQ ID NO: 4950
  source 1..203: mol_type = other DNA

SEQ ID NO: 30192 - DNA, 203 bp, Homo sapiens; identical to SEQ ID NO: 4951
  source 1..203: mol_type = other DNA

SEQ ID NO: 30193 - DNA, 203 bp, Homo sapiens; identical to SEQ ID NO: 4952
  source 1..203: mol_type = other DNA

SEQ ID NO: 30194 - DNA, 203 bp, Homo sapiens; identical to SEQ ID NO: 4953
  source 1..203: mol_type = other DNA

SEQ ID NO: 30195 - DNA, 203 bp, Homo sapiens; identical to SEQ ID NO: 4954
  source 1..203: mol_type = other DNA

SEQ ID NO: 30196 - DNA, 203 bp, Homo sapiens; identical to SEQ ID NO: 4955
  source 1..203: mol_type = other DNA

SEQ ID NO: 30197 - DNA, 203 bp, Homo sapiens; identical to SEQ ID NO: 4956
  source 1..203: mol_type = other DNA

SEQ ID NO: 30198 - DNA, 203 bp, Homo sapiens; identical to SEQ ID NO: 4957
  source 1..203: mol_type = other DNA

SEQ ID NO: 30199 - DNA, 203 bp, Homo sapiens; identical to SEQ ID NO: 4958
  source 1..203: mol_type = other DNA

SEQ ID NO: 30200 - DNA, 203 bp, Homo sapiens; identical to SEQ ID NO: 4959
  source 1..203: mol_type = other DNA

SEQ ID NO: 30201 - DNA, 203 bp, Homo sapiens; identical to SEQ ID NO: 4960
  source 1..203: mol_type = other DNA

SEQ ID NO: 30202 - DNA, 203 bp, Homo sapiens; identical to SEQ ID NO: 4961
  source 1..203: mol_type = other DNA

SEQ ID NO: 30203 - DNA, 203 bp, Homo sapiens; identical to SEQ ID NO: 4963
  source 1..203: mol_type = other DNA

SEQ ID NO: 30204 - DNA, 203 bp, Homo sapiens; identical to SEQ ID NO: 4964
  source 1..203: mol_type = other DNA

SEQ ID NO: 30205 - DNA, 203 bp, Homo sapiens; identical to SEQ ID NO: 4965
  source 1..203: mol_type = other DNA

SEQ ID NO: 30206 - DNA, 203 bp, Homo sapiens; identical to SEQ ID NO: 4966
  source 1..203: mol_type = other DNA

SEQ ID NO: 30207 - DNA, 203 bp, Homo sapiens; identical to SEQ ID NO: 4967
  source 1..203: mol_type = other DNA

SEQ ID NO: 30208 - DNA, 203 bp, Homo sapiens; identical to SEQ ID NO: 4968
  source 1..203: mol_type = other DNA

SEQ ID NO: 30209 - DNA, 203 bp, Homo sapiens; identical to SEQ ID NO: 4969
  source 1..203: mol_type = other DNA

SEQ ID NO: 30210 - DNA, 203 bp, Homo sapiens; identical to SEQ ID NO: 4970
  source 1..203: mol_type = other DNA

SEQ ID NO: 30211 - DNA, 203 bp, Homo sapiens; identical to SEQ ID NO: 4971
  source 1..203: mol_type = other DNA

SEQ ID NO: 30212 - DNA, 203 bp, Homo sapiens; identical to SEQ ID NO: 4972
  source 1..203: mol_type = other DNA

SEQ ID NO: 30213 - DNA, 203 bp, Homo sapiens; identical to SEQ ID NO: 4973
  source 1..203: mol_type = other DNA

SEQ ID NO: 30214 - DNA, 203 bp, Homo sapiens; identical to SEQ ID NO: 4974
  source 1..203: mol_type = other DNA

SEQ ID NO: 30215 - DNA, 203 bp, Homo sapiens; identical to SEQ ID NO: 4975
  source 1..203: mol_type = other DNA

SEQ ID NO: 30216 - DNA, 203 bp, Homo sapiens; identical to SEQ ID NO: 4976
  source 1..203: mol_type = other DNA

SEQ ID NO: 30217 - DNA, 203 bp, Homo sapiens; identical to SEQ ID NO: 4977
  source 1..203: mol_type = other DNA

SEQ ID NO: 30218 - DNA, 203 bp, Homo sapiens; identical to SEQ ID NO: 4978
  source 1..203: mol_type = other DNA

SEQ ID NO: 30219 - DNA, 203 bp, Homo sapiens; identical to SEQ ID NO: 4979
  source 1..203: mol_type = other DNA

SEQ ID NO: 30220 - DNA, 203 bp, Homo sapiens; identical to SEQ ID NO: 4980
  source 1..203: mol_type = other DNA

SEQ ID NO: 30221 - DNA, 203 bp, Homo sapiens; identical to SEQ ID NO: 4981
  source 1..203: mol_type = other DNA

SEQ ID NO: 30222 - DNA, 203 bp, Homo sapiens; identical to SEQ ID NO: 5012
  source 1..203: mol_type = other DNA

SEQ ID NO: 30223 - DNA, 203 bp, Homo sapiens; identical to SEQ ID NO: 5037
  source 1..203: mol_type = other DNA

SEQ ID NO: 30224 - DNA, 203 bp, Homo sapiens; identical to SEQ ID NO: 5048
  source 1..203: mol_type = other DNA

SEQ ID NO: 30225 - DNA, 203 bp, Homo sapiens; identical to SEQ ID NO: 5052
  source 1..203: mol_type = other DNA

SEQ ID NO: 30226 - DNA, 203 bp, Homo sapiens; identical to SEQ ID NO: 5053
  source 1..203: mol_type = other DNA

SEQ ID NO: 30227 - DNA, 203 bp, Homo sapiens; identical to SEQ ID NO: 5054
  source 1..203: mol_type = other DNA

SEQ ID NO: 30228 - DNA, 203 bp, Homo sapiens; identical to SEQ ID NO: 5055
  source 1..203: mol_type = other DNA

SEQ ID NO: 30229 - DNA, 203 bp, Homo sapiens; identical to SEQ ID NO: 5056
  source 1..203: mol_type = other DNA

SEQ ID NO: 30230 - DNA, 203 bp, Homo sapiens; identical to SEQ ID NO: 5057
  source 1..203: mol_type = other DNA

SEQ ID NO: 30231 - DNA, 203 bp, Homo sapiens; identical to SEQ ID NO: 5058
  source 1..203: mol_type = other DNA

SEQ ID NO: 30232 - DNA, 203 bp, Homo sapiens; identical to SEQ ID NO: 5059
  source 1..203: mol_type = other DNA

SEQ ID NO: 30233 - DNA, 203 bp, Homo sapiens; identical to SEQ ID NO: 5060
  source 1..203: mol_type = other DNA

SEQ ID NO: 30234 - DNA, 203 bp, Homo sapiens; identical to SEQ ID NO: 5066
  source 1..203: mol_type = other DNA

SEQ ID NO: 30235 - DNA, 203 bp, Homo sapiens; identical to SEQ ID NO: 5067
  source 1..203: mol_type = other DNA

SEQ ID NO: 30236 - DNA, 203 bp, Homo sapiens; identical to SEQ ID NO: 5068
  source 1..203: mol_type = other DNA

SEQ ID NO: 30237 - DNA, 203 bp, Homo sapiens; identical to SEQ ID NO: 5069
  source 1..203: mol_type = other DNA

SEQ ID NO: 30238 - DNA, 203 bp, Homo sapiens; identical to SEQ ID NO: 5084
  source 1..203: mol_type = other DNA

SEQ ID NO: 30239 - DNA, 203 bp, Homo sapiens; identical to SEQ ID NO: 5092
  source 1..203: mol_type = other DNA

SEQ ID NO: 30240 - DNA, 203 bp, Homo sapiens; identical to SEQ ID NO: 5093
  source 1..203: mol_type = other DNA

SEQ ID NO: 30241 - DNA, 203 bp, Homo sapiens; identical to SEQ ID NO: 5094
  source 1..203: mol_type = other DNA

SEQ ID NO: 30242 - DNA, 203 bp, Homo sapiens; identical to SEQ ID NO: 5095
  source 1..203: mol_type = other DNA

SEQ ID NO: 30243 - DNA, 203 bp, Homo sapiens; identical to SEQ ID NO: 5101
  source 1..203: mol_type = other DNA

SEQ ID NO: 30244 - DNA, 203 bp, Homo sapiens; identical to SEQ ID NO: 5102
  source 1..203: mol_type = other DNA

SEQ ID NO: 30245 - DNA, 203 bp, Homo sapiens; identical to SEQ ID NO: 5103
  source 1..203: mol_type = other DNA

SEQ ID NO: 30246 - DNA, 203 bp, Homo sapiens; identical to SEQ ID NO: 5106
  source 1..203: mol_type = other DNA

SEQ ID NO: 30247 - DNA, 203 bp, Homo sapiens; identical to SEQ ID NO: 5107
  source 1..203: mol_type = other DNA

SEQ ID NO: 30248 - DNA, 203 bp, Homo sapiens; identical to SEQ ID NO: 5108
  source 1..203: mol_type = other DNA

SEQ ID NO: 30249 - DNA, 203 bp, Homo sapiens; identical to SEQ ID NO: 5109
  source 1..203: mol_type = other DNA

SEQ ID NO: 30250 - DNA, 203 bp, Homo sapiens; identical to SEQ ID NO: 5110
  source 1..203: mol_type = other DNA

SEQ ID NO: 30251 - DNA, 203 bp, Homo sapiens; identical to SEQ ID NO: 5111
  source 1..203: mol_type = other DNA

SEQ ID NO: 30252 - DNA, 203 bp, Homo sapiens; identical to SEQ ID NO: 5133
  source 1..203: mol_type = other DNA

SEQ ID NO: 30253 - DNA, 203 bp, Homo sapiens; identical to SEQ ID NO: 5135
  source 1..203: mol_type = other DNA

SEQ ID NO: 30254 - DNA, 203 bp, Homo sapiens; identical to SEQ ID NO: 5139
  source 1..203: mol_type = other DNA

SEQ ID NO: 30255 - DNA, 203 bp, Homo sapiens; identical to SEQ ID NO: 5143
  source 1..203: mol_type = other DNA

SEQ ID NO: 30256 - DNA, 203 bp, Homo sapiens; identical to SEQ ID NO: 5156
  source 1..203: mol_type = other DNA

SEQ ID NO: 30257 - DNA, 203 bp, Homo sapiens; identical to SEQ ID NO: 5157
  source 1..203: mol_type = other DNA

SEQ ID NO: 30258 - DNA, 203 bp, Homo sapiens; identical to SEQ ID NO: 5158
  source 1..203: mol_type = other DNA

SEQ ID NO: 30259 - DNA, 203 bp, Homo sapiens; identical to SEQ ID NO: 5159
  source 1..203: mol_type = other DNA

SEQ ID NO: 30260 - DNA, 203 bp, Homo sapiens; identical to SEQ ID NO: 5160
  source 1..203: mol_type = other DNA

SEQ ID NO: 30261 - DNA, 203 bp, Homo sapiens; identical to SEQ ID NO: 5199
  source 1..203: mol_type = other DNA

SEQ ID NO: 30262 - DNA, 203 bp, Homo sapiens; identical to SEQ ID NO: 5200
  source 1..203: mol_type = other DNA

SEQ ID NO: 30263 - DNA, 203 bp, Homo sapiens; identical to SEQ ID NO: 5211
  source 1..203: mol_type = other DNA

SEQ ID NO: 30264 - DNA, 203 bp, Homo sapiens; identical to SEQ ID NO: 5234
  source 1..203: mol_type = other DNA

SEQ ID NO: 30265 - DNA, 203 bp, Homo sapiens; identical to SEQ ID NO: 5254
  source 1..203: mol_type = other DNA

SEQ ID NO: 30266 - DNA, 203 bp, Homo sapiens; identical to SEQ ID NO: 5260
  source 1..203: mol_type = other DNA

SEQ ID NO: 30267 - DNA, 203 bp, Homo sapiens; identical to SEQ ID NO: 5262
  source 1..203: mol_type = other DNA

SEQ ID NO: 30268 - DNA, 203 bp, Homo sapiens; identical to SEQ ID NO: 5263
  source 1..203: mol_type = other DNA

SEQ ID NO: 30269 - DNA, 203 bp, Homo sapiens; identical to SEQ ID NO: 5266
  source 1..203: mol_type = other DNA

SEQ ID NO: 30270 - DNA, 203 bp, Homo sapiens; identical to SEQ ID NO: 5271
  source 1..203: mol_type = other DNA

SEQ ID NO: 30271 - DNA, 203 bp, Homo sapiens; identical to SEQ ID NO: 5272
  source 1..203: mol_type = other DNA

SEQ ID NO: 30272 - DNA, 203 bp, Homo sapiens; identical to SEQ ID NO: 5273
  source 1..203: mol_type = other DNA

SEQ ID NO: 30273 - DNA, 203 bp, Homo sapiens; identical to SEQ ID NO: 5283
  source 1..203: mol_type = other DNA

SEQ ID NO: 30274 - DNA, 203 bp, Homo sapiens; identical to SEQ ID NO: 5284
  source 1..203: mol_type = other DNA

SEQ ID NO: 30275 - DNA, 203 bp, Homo sapiens; identical to SEQ ID NO: 5285
  source 1..203: mol_type = other DNA

SEQ ID NO: 30276 - DNA, 203 bp, Homo sapiens; identical to SEQ ID NO: 5286
  source 1..203: mol_type = other DNA

SEQ ID NO: 30277 - DNA, 203 bp, Homo sapiens; identical to SEQ ID NO: 5287
  source 1..203: mol_type = other DNA

SEQ ID NO: 30278 - DNA, 203 bp, Homo sapiens; identical to SEQ ID NO: 5288
  source 1..203: mol_type = other DNA

SEQ ID NO: 30279 - DNA, 203 bp, Homo sapiens; identical to SEQ ID NO: 5293
  source 1..203: mol_type = other DNA

SEQ ID NO: 30280 - DNA, 203 bp, Homo sapiens; identical to SEQ ID NO: 5294
  source 1..203: mol_type = other DNA

SEQ ID NO: 30281 - DNA, 203 bp, Homo sapiens; identical to SEQ ID NO: 5306
  source 1..203: mol_type = other DNA

SEQ ID NO: 30282 - DNA, 203 bp, Homo sapiens; identical to SEQ ID NO: 5307
  source 1..203: mol_type = other DNA

SEQ ID NO: 30283 - DNA, 203 bp, Homo sapiens; identical to SEQ ID NO: 5308
  source 1..203: mol_type = other DNA

SEQ ID NO: 30284 - DNA, 203 bp, Homo sapiens; identical to SEQ ID NO: 5309
  source 1..203: mol_type = other DNA

SEQ ID NO: 30285 - DNA, 203 bp, Homo sapiens; identical to SEQ ID NO: 5310
  source 1..203: mol_type = other DNA

SEQ ID NO: 30286 - DNA, 203 bp, Homo sapiens; identical to SEQ ID NO: 5311
  source 1..203: mol_type = other DNA

SEQ ID NO: 30287 - DNA, 203 bp, Homo sapiens; identical to SEQ ID NO: 5312
  source 1..203: mol_type = other DNA

SEQ ID NO: 30288 - DNA, 203 bp, Homo sapiens; identical to SEQ ID NO: 5313
  source 1..203: mol_type = other DNA

SEQ ID NO: 30289 - DNA, 203 bp, Homo sapiens; identical to SEQ ID NO: 5314
  source 1..203: mol_type = other DNA

SEQ ID NO: 30290 - DNA, 203 bp, Homo sapiens; identical to SEQ ID NO: 5315
  source 1..203: mol_type = other DNA

SEQ ID NO: 30291 - DNA, 203 bp, Homo sapiens; identical to SEQ ID NO: 5316
  source 1..203: mol_type = other DNA

SEQ ID NO: 30292 - DNA, 203 bp, Homo sapiens; identical to SEQ ID NO: 5317
  source 1..203: mol_type = other DNA

SEQ ID NO: 30293 - DNA, 203 bp, Homo sapiens; identical to SEQ ID NO: 5318
  source 1..203: mol_type = other DNA

SEQ ID NO: 30294 - DNA, 203 bp, Homo sapiens; identical to SEQ ID NO: 5319
  source 1..203: mol_type = other DNA

SEQ ID NO: 30295 - DNA, 203 bp, Homo sapiens; identical to SEQ ID NO: 5320
  source 1..203: mol_type = other DNA

SEQ ID NO: 30296 - DNA, 203 bp, Homo sapiens; identical to SEQ ID NO: 5321
  source 1..203: mol_type = other DNA

SEQ ID NO: 30297 - DNA, 203 bp, Homo sapiens; identical to SEQ ID NO: 5322
  source 1..203: mol_type = other DNA

SEQ ID NO: 30298 - DNA, 203 bp, Homo sapiens; identical to SEQ ID NO: 5323
  source 1..203: mol_type = other DNA

SEQ ID NO: 30299 - DNA, 203 bp, Homo sapiens; identical to SEQ ID NO: 5324
  source 1..203: mol_type = other DNA

SEQ ID NO: 30300 - DNA, 203 bp, Homo sapiens; identical to SEQ ID NO: 5325
  source 1..203: mol_type = other DNA

SEQ ID NO: 30301 - DNA, 203 bp, Homo sapiens; identical to SEQ ID NO: 5326
  source 1..203: mol_type = other DNA

SEQ ID NO: 30302 - DNA, 203 bp, Homo sapiens; identical to SEQ ID NO: 5327
  source 1..203: mol_type = other DNA

SEQ ID NO: 30303 - DNA, 203 bp, Homo sapiens; identical to SEQ ID NO: 5328
  source 1..203: mol_type = other DNA

SEQ ID NO: 30304 - DNA, 203 bp, Homo sapiens; identical to SEQ ID NO: 5329
  source 1..203: mol_type = other DNA

SEQ ID NO: 30305 - DNA, 203 bp, Homo sapiens; identical to SEQ ID NO: 5330
  source 1..203: mol_type = other DNA

SEQ ID NO: 30306 - DNA, 203 bp, Homo sapiens; identical to SEQ ID NO: 5331
  source 1..203: mol_type = other DNA

SEQ ID NO: 30307 - DNA, 203 bp, Homo sapiens; identical to SEQ ID NO: 5334
  source 1..203: mol_type = other DNA

SEQ ID NO: 30308 - DNA, 203 bp, Homo sapiens; identical to SEQ ID NO: 5365
  source 1..203: mol_type = other DNA

SEQ ID NO: 30309 - DNA, 203 bp, Homo sapiens; identical to SEQ ID NO: 5366
  source 1..203: mol_type = other DNA

SEQ ID NO: 30310 - DNA, 203 bp, Homo sapiens; identical to SEQ ID NO: 5367
  source 1..203: mol_type = other DNA

SEQ ID NO: 30311 - DNA, 203 bp, Homo sapiens; identical to SEQ ID NO: 5368
  source 1..203: mol_type = other DNA

SEQ ID NO: 30312 - DNA, 203 bp, Homo sapiens; identical to SEQ ID NO: 5371
  source 1..203: mol_type = other DNA

SEQ ID NO: 30313 - DNA, 203 bp, Homo sapiens; identical to SEQ ID NO: 5381
  source 1..203: mol_type = other DNA

SEQ ID NO: 30314 - DNA, 203 bp, Homo sapiens; identical to SEQ ID NO: 5382
  source 1..203: mol_type = other DNA

SEQ ID NO: 30315 - DNA, 203 bp, Homo sapiens; identical to SEQ ID NO: 5383
  source 1..203: mol_type = other DNA

SEQ ID NO: 30316 - DNA, 203 bp, Homo sapiens; identical to SEQ ID NO: 5384
  source 1..203: mol_type = other DNA

SEQ ID NO: 30317 - DNA, 203 bp, Homo sapiens; identical to SEQ ID NO: 5385
  source 1..203: mol_type = other DNA

SEQ ID NO: 30318 - DNA, 203 bp, Homo sapiens; identical to SEQ ID NO: 5386
  source 1..203: mol_type = other DNA

SEQ ID NO: 30319 - DNA, 203 bp, Homo sapiens; identical to SEQ ID NO: 5387
  source 1..203: mol_type = other DNA

SEQ ID NO: 30320 - DNA, 203 bp, Homo sapiens; identical to SEQ ID NO: 5388
  source 1..203: mol_type = other DNA

SEQ ID NO: 30321 - DNA, 203 bp, Homo sapiens; identical to SEQ ID NO: 5389
  source 1..203: mol_type = other DNA

SEQ ID NO: 30322 - DNA, 203 bp, Homo sapiens; identical to SEQ ID NO: 5390
  source 1..203: mol_type = other DNA

SEQ ID NO: 30323 - DNA, 203 bp, Homo sapiens; identical to SEQ ID NO: 5391
  source 1..203: mol_type = other DNA

SEQ ID NO: 30324 - DNA, 203 bp, Homo sapiens; identical to SEQ ID NO: 5395
  source 1..203: mol_type = other DNA

SEQ ID NO: 30325 - DNA, 203 bp, Homo sapiens; identical to SEQ ID NO: 5396
  source 1..203: mol_type = other DNA

SEQ ID NO: 30326 - DNA, 203 bp, Homo sapiens; identical to SEQ ID NO: 5397
  source 1..203: mol_type = other DNA

SEQ ID NO: 30327 - DNA, 203 bp, Homo sapiens; identical to SEQ ID NO: 5398
  source 1..203: mol_type = other DNA

SEQ ID NO: 30328 - DNA, 203 bp, Homo sapiens; identical to SEQ ID NO: 5399
  source 1..203: mol_type = other DNA

SEQ ID NO: 30329 - DNA, 203 bp, Homo sapiens; identical to SEQ ID NO: 5400
  source 1..203: mol_type = other DNA

SEQ ID NO: 30330 - DNA, 203 bp, Homo sapiens; identical to SEQ ID NO: 5401
  source 1..203: mol_type = other DNA

SEQ ID NO: 30331 - DNA, 203 bp, Homo sapiens; identical to SEQ ID NO: 5402
  source 1..203: mol_type = other DNA

SEQ ID NO: 30332 - DNA, 203 bp, Homo sapiens; identical to SEQ ID NO: 5403
  source 1..203: mol_type = other DNA

SEQ ID NO: 30333 - DNA, 203 bp, Homo sapiens; identical to SEQ ID NO: 5404
  source 1..203: mol_type = other DNA

SEQ ID NO: 30334 - DNA, 203 bp, Homo sapiens; identical to SEQ ID NO: 5405
  source 1..203: mol_type = other DNA

SEQ ID NO: 30335 - DNA, 203 bp, Homo sapiens; identical to SEQ ID NO: 5412
  source 1..203: mol_type = other DNA

SEQ ID NO: 30336 - DNA, 203 bp, Homo sapiens; identical to SEQ ID NO: 5413
  source 1..203: mol_type = other DNA

SEQ ID NO: 30337 - DNA, 203 bp, Homo sapiens; identical to SEQ ID NO: 5414
  source 1..203: mol_type = other DNA

SEQ ID NO: 30338 - DNA, 203 bp, Homo sapiens; identical to SEQ ID NO: 5415
  source 1..203: mol_type = other DNA

SEQ ID NO: 30339 - DNA, 203 bp, Homo sapiens; identical to SEQ ID NO: 5416
  source 1..203: mol_type = other DNA

SEQ ID NO: 30340 - DNA, 203 bp, Homo sapiens; identical to SEQ ID NO: 5417
  source 1..203: mol_type = other DNA

SEQ ID NO: 30341 - DNA, 203 bp, Homo sapiens; identical to SEQ ID NO: 5418
  source 1..203: mol_type = other DNA

SEQ ID NO: 30342 - DNA, 203 bp, Homo sapiens; identical to SEQ ID NO: 5419
  source 1..203: mol_type = other DNA

SEQ ID NO: 30343 - DNA, 203 bp, Homo sapiens; identical to SEQ ID NO: 5420
  source 1..203: mol_type = other DNA

SEQ ID NO: 30344 - DNA, 203 bp, Homo sapiens; identical to SEQ ID NO: 5421
  source 1..203: mol_type = other DNA

SEQ ID NO: 30345 - DNA, 203 bp, Homo sapiens; identical to SEQ ID NO: 5422
  source 1..203: mol_type = other DNA

SEQ ID NO: 30346 - DNA, 203 bp, Homo sapiens; identical to SEQ ID NO: 5423
  source 1..203: mol_type = other DNA

SEQ ID NO: 30347 - DNA, 203 bp, Homo sapiens; identical to SEQ ID NO: 5424
  source 1..203: mol_type = other DNA

SEQ ID NO: 30348 - DNA, 203 bp, Homo sapiens; identical to SEQ ID NO: 5425
  source 1..203: mol_type = other DNA

SEQ ID NO: 30349 - DNA, 203 bp, Homo sapiens; identical to SEQ ID NO: 5426
  source 1..203: mol_type = other DNA

SEQ ID NO: 30350 - DNA, 203 bp, Homo sapiens; identical to SEQ ID NO: 5427
  source 1..203: mol_type = other DNA

SEQ ID NO: 30351 - DNA, 203 bp, Homo sapiens; identical to SEQ ID NO: 5428
  source 1..203: mol_type = other DNA

SEQ ID NO: 30352 - DNA, 203 bp, Homo sapiens; identical to SEQ ID NO: 5429
  source 1..203: mol_type = other DNA

SEQ ID NO: 30353 - DNA, 203 bp, Homo sapiens; identical to SEQ ID NO: 5430
  source 1..203: mol_type = other DNA

SEQ ID NO: 30354 - DNA, 203 bp, Homo sapiens; identical to SEQ ID NO: 5431
  source 1..203: mol_type = other DNA

SEQ ID NO: 30355 - DNA, 203 bp, Homo sapiens; identical to SEQ ID NO: 5432
  source 1..203: mol_type = other DNA

SEQ ID NO: 30356 - DNA, 203 bp, Homo sapiens; identical to SEQ ID NO: 5433
  source 1..203: mol_type = other DNA

SEQ ID NO: 30357 - DNA, 203 bp, Homo sapiens; identical to SEQ ID NO: 5434
  source 1..203: mol_type = other DNA

SEQ ID NO: 30358 - DNA, 203 bp, Homo sapiens; identical to SEQ ID NO: 5449
  source 1..203: mol_type = other DNA

SEQ ID NO: 30359 - DNA, 203 bp, Homo sapiens; identical to SEQ ID NO: 5458
  source 1..203: mol_type = other DNA

SEQ ID NO: 30360 - DNA, 203 bp, Homo sapiens; identical to SEQ ID NO: 5466
  source 1..203: mol_type = other DNA

SEQ ID NO: 30361 - DNA, 203 bp, Homo sapiens; identical to SEQ ID NO: 5467
  source 1..203: mol_type = other DNA

SEQ ID NO: 30362 - DNA, 203 bp, Homo sapiens; identical to SEQ ID NO: 5468
  source 1..203: mol_type = other DNA

SEQ ID NO: 30363 - DNA, 203 bp, Homo sapiens; identical to SEQ ID NO: 5469
  source 1..203: mol_type = other DNA

SEQ ID NO: 30364 - DNA, 203 bp, Homo sapiens; identical to SEQ ID NO: 5470
  source 1..203: mol_type = other DNA

SEQ ID NO: 30365 - DNA, 203 bp, Homo sapiens; identical to SEQ ID NO: 5471
  source 1..203: mol_type = other DNA

SEQ ID NO: 30366 - DNA, 203 bp, Homo sapiens; identical to SEQ ID NO: 5481
  source 1..203: mol_type = other DNA

SEQ ID NO: 30367 - DNA, 203 bp, Homo sapiens; identical to SEQ ID NO: 5482
  source 1..203: mol_type = other DNA

SEQ ID NO: 30368 - DNA, 203 bp, Homo sapiens; identical to SEQ ID NO: 5483
  source 1..203: mol_type = other DNA

SEQ ID NO: 30369 - DNA, 203 bp, Homo sapiens; identical to SEQ ID NO: 5484
  source 1..203: mol_type = other DNA

SEQ ID NO: 30370 - DNA, 203 bp, Homo sapiens; identical to SEQ ID NO: 5485
  source 1..203: mol_type = other DNA

SEQ ID NO: 30371 - DNA, 203 bp, Homo sapiens; identical to SEQ ID NO: 5486
  source 1..203: mol_type = other DNA

SEQ ID NO: 30372 - DNA, 203 bp, Homo sapiens; identical to SEQ ID NO: 5487
  source 1..203: mol_type = other DNA

SEQ ID NO: 30373 - DNA, 203 bp, Homo sapiens; identical to SEQ ID NO: 5488
  source 1..203: mol_type = other DNA

SEQ ID NO: 30374 - DNA, 203 bp, Homo sapiens; identical to SEQ ID NO: 5489
  source 1..203: mol_type = other DNA

SEQ ID NO: 30375 - DNA, 203 bp, Homo sapiens; identical to SEQ ID NO: 5490
  source 1..203: mol_type = other DNA

SEQ ID NO: 30376 - DNA, 203 bp, Homo sapiens; identical to SEQ ID NO: 5491
  source 1..203: mol_type = other DNA

SEQ ID NO: 30377 - DNA, 203 bp, Homo sapiens; identical to SEQ ID NO: 5492
  source 1..203: mol_type = other DNA

SEQ ID NO: 30378 - DNA, 203 bp, Homo sapiens; identical to SEQ ID NO: 5493
  source 1..203: mol_type = other DNA

SEQ ID NO: 30379 - DNA, 203 bp, Homo sapiens; identical to SEQ ID NO: 5510
  source 1..203: mol_type = other DNA

SEQ ID NO: 30380 - DNA, 203 bp, Homo sapiens; identical to SEQ ID NO: 5511
  source 1..203: mol_type = other DNA

SEQ ID NO: 30381 - DNA, 203 bp, Homo sapiens; identical to SEQ ID NO: 5512
  source 1..203: mol_type = other DNA

SEQ ID NO: 30382 - DNA, 203 bp, Homo sapiens; identical to SEQ ID NO: 5515
  source 1..203: mol_type = other DNA

SEQ ID NO: 30383 - DNA, 203 bp, Homo sapiens; identical to SEQ ID NO: 5516
  source 1..203: mol_type = other DNA

SEQ ID NO: 30384 - DNA, 203 bp, Homo sapiens; identical to SEQ ID NO: 5517
  source 1..203: mol_type = other DNA

SEQ ID NO: 30385 - DNA, 203 bp, Homo sapiens; identical to SEQ ID NO: 5518
  source 1..203: mol_type = other DNA

SEQ ID NO: 30386 - DNA, 203 bp, Homo sapiens; identical to SEQ ID NO: 5519
  source 1..203: mol_type = other DNA

SEQ ID NO: 30387 - DNA, 203 bp, Homo sapiens; identical to SEQ ID NO: 5544
  source 1..203: mol_type = other DNA

SEQ ID NO: 30388 - DNA, 203 bp, Homo sapiens; identical to SEQ ID NO: 5550
  source 1..203: mol_type = other DNA

SEQ ID NO: 30389 - DNA, 203 bp, Homo sapiens; identical to SEQ ID NO: 5552
  source 1..203: mol_type = other DNA

SEQ ID NO: 30390 - DNA, 203 bp, Homo sapiens; identical to SEQ ID NO: 5556
  source 1..203: mol_type = other DNA

SEQ ID NO: 30391 - DNA, 203 bp, Homo sapiens; identical to SEQ ID NO: 5557
  source 1..203: mol_type = other DNA

SEQ ID NO: 30392 - DNA, 203 bp, Homo sapiens; identical to SEQ ID NO: 5558
  source 1..203: mol_type = other DNA

SEQ ID NO: 30393 - DNA, 203 bp, Homo sapiens; identical to SEQ ID NO: 5568
  source 1..203: mol_type = other DNA

SEQ ID NO: 30394 - DNA, 203 bp, Homo sapiens; identical to SEQ ID NO: 5569
  source 1..203: mol_type = other DNA

SEQ ID NO: 30395 - DNA, 203 bp, Homo sapiens; identical to SEQ ID NO: 5570
  source 1..203: mol_type = other DNA

SEQ ID NO: 30396 - DNA, 203 bp, Homo sapiens; identical to SEQ ID NO: 5571
  source 1..203: mol_type = other DNA

SEQ ID NO: 30397 - DNA, 203 bp, Homo sapiens; identical to SEQ ID NO: 5572
  source 1..203: mol_type = other DNA

SEQ ID NO: 30398 - DNA, 203 bp, Homo sapiens; identical to SEQ ID NO: 5573
  source 1..203: mol_type = other DNA

SEQ ID NO: 30399 - DNA, 203 bp, Homo sapiens; identical to SEQ ID NO: 5574
  source 1..203: mol_type = other DNA

SEQ ID NO: 30400 - DNA, 203 bp, Homo sapiens; identical to SEQ ID NO: 5575
  source 1..203: mol_type = other DNA

SEQ ID NO: 30401 - DNA, 203 bp, Homo sapiens; identical to SEQ ID NO: 5576
  source 1..203: mol_type = other DNA

SEQ ID NO: 30402 - DNA, 203 bp, Homo sapiens; identical to SEQ ID NO: 5577
  source 1..203: mol_type = other DNA

SEQ ID NO: 30403 - DNA, 203 bp, Homo sapiens; identical to SEQ ID NO: 5578
  source 1..203: mol_type = other DNA

SEQ ID NO: 30404 - DNA, 203 bp, Homo sapiens; identical to SEQ ID NO: 5579
  source 1..203: mol_type = other DNA

SEQ ID NO: 30405 - DNA, 203 bp, Homo sapiens; identical to SEQ ID NO: 5580
  source 1..203: mol_type = other DNA

SEQ ID NO: 30406 - DNA, 203 bp, Homo sapiens; identical to SEQ ID NO: 5581
  source 1..203: mol_type = other DNA

SEQ ID NO: 30407 - DNA, 203 bp, Homo sapiens; identical to SEQ ID NO: 5582
  source 1..203: mol_type = other DNA

SEQ ID NO: 30408 - DNA, 203 bp, Homo sapiens; identical to SEQ ID NO: 5583
  source 1..203: mol_type = other DNA

SEQ ID NO: 30409 - DNA, 203 bp, Homo sapiens; identical to SEQ ID NO: 5584
  source 1..203: mol_type = other DNA

SEQ ID NO: 30410 - DNA, 203 bp, Homo sapiens; identical to SEQ ID NO: 5592
  source 1..203: mol_type = other DNA

SEQ ID NO: 30411 - DNA, 203 bp, Homo sapiens; identical to SEQ ID NO: 5593
  source 1..203: mol_type = other DNA

SEQ ID NO: 30412 - DNA, 203 bp, Homo sapiens; identical to SEQ ID NO: 5594
  source 1..203: mol_type = other DNA

SEQ ID NO: 30413 - DNA, 203 bp, Homo sapiens; identical to SEQ ID NO: 5595
  source 1..203: mol_type = other DNA

SEQ ID NO: 30414 - DNA, 203 bp, Homo sapiens; identical to SEQ ID NO: 5596
  source 1..203: mol_type = other DNA

SEQ ID NO: 30415 - DNA, 203 bp, Homo sapiens; identical to SEQ ID NO: 5597
  source 1..203: mol_type = other DNA

SEQ ID NO: 30416 - DNA, 203 bp, Homo sapiens; identical to SEQ ID NO: 5598
  source 1..203: mol_type = other DNA

SEQ ID NO: 30417 - DNA, 203 bp, Homo sapiens; identical to SEQ ID NO: 5599
  source 1..203: mol_type = other DNA

SEQ ID NO: 30418 - DNA, 203 bp, Homo sapiens; identical to SEQ ID NO: 5603
  source 1..203: mol_type = other DNA

SEQ ID NO: 30419 - DNA, 203 bp, Homo sapiens; identical to SEQ ID NO: 5607
  source 1..203: mol_type = other DNA

SEQ ID NO: 30420 - DNA, 203 bp, Homo sapiens; identical to SEQ ID NO: 5608
  source 1..203: mol_type = other DNA

SEQ ID NO: 30421 - DNA, 203 bp, Homo sapiens; identical to SEQ ID NO: 5613
  source 1..203: mol_type = other DNA

SEQ ID NO: 30422 - DNA, 203 bp, Homo sapiens; identical to SEQ ID NO: 5614
  source 1..203: mol_type = other DNA

SEQ ID NO: 30423 - DNA, 203 bp, Homo sapiens; identical to SEQ ID NO: 5615
  source 1..203: mol_type = other DNA

SEQ ID NO: 30424 - DNA, 203 bp, Homo sapiens; identical to SEQ ID NO: 5616
  source 1..203: mol_type = other DNA

SEQ ID NO: 30425 - DNA, 203 bp, Homo sapiens; identical to SEQ ID NO: 5617
  source 1..203: mol_type = other DNA

SEQ ID NO: 30426 - DNA, 203 bp, Homo sapiens; identical to SEQ ID NO: 5618
  source 1..203: mol_type = other DNA

SEQ ID NO: 30427 - DNA, 203 bp, Homo sapiens; identical to SEQ ID NO: 5619
  source 1..203: mol_type = other DNA

SEQ ID NO: 30428 - DNA, 203 bp, Homo sapiens; identical to SEQ ID NO: 5620
  source 1..203: mol_type = other DNA

SEQ ID NO: 30429 - DNA, 203 bp, Homo sapiens; identical to SEQ ID NO: 5621
  source 1..203: mol_type = other DNA

SEQ ID NO: 30430 - DNA, 203 bp, Homo sapiens; identical to SEQ ID NO: 5622
  source 1..203: mol_type = other DNA

SEQ ID NO: 30431 - DNA, 203 bp, Homo sapiens; identical to SEQ ID NO: 5627
  source 1..203: mol_type = other DNA

SEQ ID NO: 30432 - DNA, 203 bp, Homo sapiens; identical to SEQ ID NO: 5628
  source 1..203: mol_type = other DNA

SEQ ID NO: 30433 - DNA, 203 bp, Homo sapiens; identical to SEQ ID NO: 5629
  source 1..203: mol_type = other DNA

SEQ ID NO: 30434 - DNA, 203 bp, Homo sapiens; identical to SEQ ID NO: 5630
  source 1..203: mol_type = other DNA

SEQ ID NO: 30435 - DNA, 203 bp, Homo sapiens; identical to SEQ ID NO: 5631
  source 1..203: mol_type = other DNA

SEQ ID NO: 30436 - DNA, 203 bp, Homo sapiens; identical to SEQ ID NO: 5632
  source 1..203: mol_type = other DNA

SEQ ID NO: 30437 - DNA, 203 bp, Homo sapiens; identical to SEQ ID NO: 5633
  source 1..203: mol_type = other DNA

SEQ ID NO: 30438 - DNA, 203 bp, Homo sapiens; identical to SEQ ID NO: 5634
  source 1..203: mol_type = other DNA

SEQ ID NO: 30439 - DNA, 203 bp, Homo sapiens; identical to SEQ ID NO: 5635
  source 1..203: mol_type = other DNA

SEQ ID NO: 30440 - DNA, 203 bp, Homo sapiens; identical to SEQ ID NO: 5636
  source 1..203: mol_type = other DNA

SEQ ID NO: 30441 - DNA, 203 bp, Homo sapiens; identical to SEQ ID NO: 5637
  source 1..203: mol_type = other DNA

SEQ ID NO: 30442 - DNA, 203 bp, Homo sapiens; identical to SEQ ID NO: 5638
  source 1..203: mol_type = other DNA

SEQ ID NO: 30443 - DNA, 203 bp, Homo sapiens; identical to SEQ ID NO: 5639
  source 1..203: mol_type = other DNA

SEQ ID NO: 30444 - DNA, 203 bp, Homo sapiens; identical to SEQ ID NO: 5640
  source 1..203: mol_type = other DNA

SEQ ID NO: 30445 - DNA, 203 bp, Homo sapiens; identical to SEQ ID NO: 5641
  source 1..203: mol_type = other DNA

SEQ ID NO: 30446 - DNA, 203 bp, Homo sapiens; identical to SEQ ID NO: 5642
  source 1..203: mol_type = other DNA

SEQ ID NO: 30447 - DNA, 203 bp, Homo sapiens; identical to SEQ ID NO: 5643
  source 1..203: mol_type = other DNA

SEQ ID NO: 30448 - DNA, 203 bp, Homo sapiens; identical to SEQ ID NO: 5644
  source 1..203: mol_type = other DNA

SEQ ID NO: 30449 - DNA, 203 bp, Homo sapiens; identical to SEQ ID NO: 5645
  source 1..203: mol_type = other DNA

SEQ ID NO: 30450 - DNA, 203 bp, Homo sapiens; identical to SEQ ID NO: 5676
  source 1..203: mol_type = other DNA

SEQ ID NO: 30451 - DNA, 203 bp, Homo sapiens; identical to SEQ ID NO: 5677
  source 1..203: mol_type = other DNA

SEQ ID NO: 30452 - DNA, 203 bp, Homo sapiens; identical to SEQ ID NO: 5678
  source 1..203: mol_type = other DNA

SEQ ID NO: 30453 - DNA, 203 bp, Homo sapiens; identical to SEQ ID NO: 5679
  source 1..203: mol_type = other DNA

SEQ ID NO: 30454 - DNA, 203 bp, Homo sapiens; identical to SEQ ID NO: 5682
  source 1..203: mol_type = other DNA

SEQ ID NO: 30455 - DNA, 203 bp, Homo sapiens; identical to SEQ ID NO: 5687
  source 1..203: mol_type = other DNA

SEQ ID NO: 30456 - DNA, 203 bp, Homo sapiens; identical to SEQ ID NO: 5688
  source 1..203: mol_type = other DNA

SEQ ID NO: 30457 - DNA, 203 bp, Homo sapiens; identical to SEQ ID NO: 5689
  source 1..203: mol_type = other DNA

SEQ ID NO: 30458 - DNA, 203 bp, Homo sapiens; identical to SEQ ID NO: 5691
  source 1..203: mol_type = other DNA

SEQ ID NO: 30459 - DNA, 203 bp, Homo sapiens; identical to SEQ ID NO: 5692
  source 1..203: mol_type = other DNA

SEQ ID NO: 30460 - DNA, 203 bp, Homo sapiens; identical to SEQ ID NO: 5693
  source 1..203: mol_type = other DNA

SEQ ID NO: 30461 - DNA, 203 bp, Homo sapiens; identical to SEQ ID NO: 5694
  source 1..203: mol_type = other DNA

SEQ ID NO: 30462 - DNA, 203 bp, Homo sapiens; identical to SEQ ID NO: 5695
  source 1..203: mol_type = other DNA

SEQ ID NO: 30463 - DNA, 203 bp, Homo sapiens; identical to SEQ ID NO: 5696
  source 1..203: mol_type = other DNA

SEQ ID NO: 30464 - DNA, 203 bp, Homo sapiens; identical to SEQ ID NO: 5697
  source 1..203: mol_type = other DNA

SEQ ID NO: 30465 - DNA, 203 bp, Homo sapiens; identical to SEQ ID NO: 5706
  source 1..203: mol_type = other DNA

SEQ ID NO: 30466 - DNA, 203 bp, Homo sapiens; identical to SEQ ID NO: 5707
  source 1..203: mol_type = other DNA

SEQ ID NO: 30467 - DNA, 203 bp, Homo sapiens; identical to SEQ ID NO: 5708
  source 1..203: mol_type = other DNA

SEQ ID NO: 30468 - DNA, 203 bp, Homo sapiens; identical to SEQ ID NO: 5709
  source 1..203: mol_type = other DNA

SEQ ID NO: 30469 - DNA, 203 bp, Homo sapiens; identical to SEQ ID NO: 5711
  source 1..203: mol_type = other DNA

SEQ ID NO: 30470 - DNA, 203 bp, Homo sapiens; identical to SEQ ID NO: 5712
  source 1..203: mol_type = other DNA

SEQ ID NO: 30471 - DNA, 203 bp, Homo sapiens; identical to SEQ ID NO: 5713
  source 1..203: mol_type = other DNA

SEQ ID NO: 30472 - DNA, 203 bp, Homo sapiens; identical to SEQ ID NO: 5714
  source 1..203: mol_type = other DNA

SEQ ID NO: 30473 - DNA, 203 bp, Homo sapiens; identical to SEQ ID NO: 5715
  source 1..203: mol_type = other DNA

SEQ ID NO: 30474 - DNA, 203 bp, Homo sapiens; identical to SEQ ID NO: 5716
  source 1..203: mol_type = other DNA

SEQ ID NO: 30475 - DNA, 203 bp, Homo sapiens; identical to SEQ ID NO: 5717
  source 1..203: mol_type = other DNA

SEQ ID NO: 30476 - DNA, 203 bp, Homo sapiens; identical to SEQ ID NO: 5718
  source 1..203: mol_type = other DNA

SEQ ID NO: 30477 - DNA, 203 bp, Homo sapiens; identical to SEQ ID NO: 5724
  source 1..203: mol_type = other DNA

SEQ ID NO: 30478 - DNA, 203 bp, Homo sapiens; identical to SEQ ID NO: 5725
  source 1..203: mol_type = other DNA

SEQ ID NO: 30479 - DNA, 203 bp, Homo sapiens; identical to SEQ ID NO: 5726
  source 1..203: mol_type = other DNA

SEQ ID NO: 30480 - DNA, 203 bp, Homo sapiens; identical to SEQ ID NO: 5727
  source 1..203: mol_type = other DNA

SEQ ID NO: 30481 - DNA, 203 bp, Homo sapiens; identical to SEQ ID NO: 5728
  source 1..203: mol_type = other DNA

SEQ ID NO: 30482 - DNA, 203 bp, Homo sapiens; identical to SEQ ID NO: 5729
  source 1..203: mol_type = other DNA

SEQ ID NO: 30483 - DNA, 203 bp, Homo sapiens; identical to SEQ ID NO: 5730
  source 1..203: mol_type = other DNA

SEQ ID NO: 30484 - DNA, 203 bp, Homo sapiens; identical to SEQ ID NO: 5731
  source 1..203: mol_type = other DNA

SEQ ID NO: 30485 - DNA, 203 bp, Homo sapiens; identical to SEQ ID NO: 5732
  source 1..203: mol_type = other DNA

SEQ ID NO: 30486 - DNA, 203 bp, Homo sapiens; identical to SEQ ID NO: 5740
  source 1..203: mol_type = other DNA

SEQ ID NO: 30487 - DNA, 203 bp, Homo sapiens; identical to SEQ ID NO: 5741
  source 1..203: mol_type = other DNA

SEQ ID NO: 30488 - DNA, 203 bp, Homo sapiens; identical to SEQ ID NO: 5742
  source 1..203: mol_type = other DNA

SEQ ID NO: 30489 - DNA, 203 bp, Homo sapiens; identical to SEQ ID NO: 5746
  source 1..203: mol_type = other DNA

SEQ ID NO: 30490 - DNA, 203 bp, Homo sapiens; identical to SEQ ID NO: 5781
  source 1..203: mol_type = other DNA

SEQ ID NO: 30491 - DNA, 203 bp, Homo sapiens; identical to SEQ ID NO: 5783
  source 1..203: mol_type = other DNA

SEQ ID NO: 30492 - DNA, 203 bp, Homo sapiens; identical to SEQ ID NO: 5798
  source 1..203: mol_type = other DNA

SEQ ID NO: 30493 - DNA, 203 bp, Homo sapiens; identical to SEQ ID NO: 5799
  source 1..203: mol_type = other DNA

SEQ ID NO: 30494 - DNA, 203 bp, Homo sapiens; identical to SEQ ID NO: 5800
  source 1..203: mol_type = other DNA

SEQ ID NO: 30495 - DNA, 203 bp, Homo sapiens; identical to SEQ ID NO: 5801
  source 1..203: mol_type = other DNA

SEQ ID NO: 30496 - DNA, 203 bp, Homo sapiens; identical to SEQ ID NO: 5802
  source 1..203: mol_type = other DNA

SEQ ID NO: 30497 - DNA, 203 bp, Homo sapiens; identical to SEQ ID NO: 5803
  source 1..203: mol_type = other DNA

SEQ ID NO: 30498 - DNA, 203 bp, Homo sapiens; identical to SEQ ID NO: 5804
  source 1..203: mol_type = other DNA

SEQ ID NO: 30499 - DNA, 203 bp, Homo sapiens; identical to SEQ ID NO: 5842
  source 1..203: mol_type = other DNA

SEQ ID NO: 30500 - DNA, 203 bp, Homo sapiens; identical to SEQ ID NO: 5843
  source 1..203: mol_type = other DNA

SEQ ID NO: 30501 - DNA, 203 bp, Homo sapiens; identical to SEQ ID NO: 5844
  source 1..203: mol_type = other DNA

SEQ ID NO: 30502 - DNA, 203 bp, Homo sapiens; identical to SEQ ID NO: 5845
  source 1..203: mol_type = other DNA

SEQ ID NO: 30503 - DNA, 203 bp, Homo sapiens; identical to SEQ ID NO: 5846
  source 1..203: mol_type = other DNA

SEQ ID NO: 30504 - DNA, 203 bp, Homo sapiens; identical to SEQ ID NO: 5847
  source 1..203: mol_type = other DNA

SEQ ID NO: 30505 - DNA, 203 bp, Homo sapiens; identical to SEQ ID NO: 5848
  source 1..203: mol_type = other DNA

SEQ ID NO: 30506 - DNA, 203 bp, Homo sapiens; identical to SEQ ID NO: 5849
  source 1..203: mol_type = other DNA

SEQ ID NO: 30507 - DNA, 203 bp, Homo sapiens; identical to SEQ ID NO: 5850
  source 1..203: mol_type = other DNA

SEQ ID NO: 30508 - DNA, 203 bp, Homo sapiens; identical to SEQ ID NO: 5851
  source 1..203: mol_type = other DNA

SEQ ID NO: 30509 - DNA, 203 bp, Homo sapiens; identical to SEQ ID NO: 5852
  source 1..203: mol_type = other DNA

SEQ ID NO: 30510 - DNA, 203 bp, Homo sapiens; identical to SEQ ID NO: 5853
  source 1..203: mol_type = other DNA

SEQ ID NO: 30511 - DNA, 203 bp, Homo sapiens; identical to SEQ ID NO: 5870
  source 1..203: mol_type = other DNA

SEQ ID NO: 30512 - DNA, 203 bp, Homo sapiens; identical to SEQ ID NO: 5921
  source 1..203: mol_type = other DNA

SEQ ID NO: 30513 - DNA, 203 bp, Homo sapiens; identical to SEQ ID NO: 5922
  source 1..203: mol_type = other DNA

SEQ ID NO: 30514 - DNA, 203 bp, Homo sapiens; identical to SEQ ID NO: 5923
  source 1..203: mol_type = other DNA

SEQ ID NO: 30515 - DNA, 203 bp, Homo sapiens; identical to SEQ ID NO: 5942
  source 1..203: mol_type = other DNA

SEQ ID NO: 30516 - DNA, 203 bp, Homo sapiens; identical to SEQ ID NO: 5943
  source 1..203: mol_type = other DNA

SEQ ID NO: 30517 - DNA, 203 bp, Homo sapiens; identical to SEQ ID NO: 5944
  source 1..203: mol_type = other DNA

SEQ ID NO: 30518 - DNA, 203 bp, Homo sapiens; identical to SEQ ID NO: 5945
  source 1..203: mol_type = other DNA

SEQ ID NO: 30519 - DNA, 203 bp, Homo sapiens; identical to SEQ ID NO: 5958
  source 1..203: mol_type = other DNA

SEQ ID NO: 30520 - DNA, 203 bp, Homo sapiens; identical to SEQ ID NO: 5959
  source 1..203: mol_type = other DNA

SEQ ID NO: 30521 - DNA, 203 bp, Homo sapiens; identical to SEQ ID NO: 5960
  source 1..203: mol_type = other DNA

SEQ ID NO: 30522 - DNA, 203 bp, Homo sapiens; identical to SEQ ID NO: 5961
  source 1..203: mol_type = other DNA

SEQ ID NO: 30523 - DNA, 203 bp, Homo sapiens; identical to SEQ ID NO: 5962
  source 1..203: mol_type = other DNA

SEQ ID NO: 30524 - DNA, 203 bp, Homo sapiens; identical to SEQ ID NO: 5963
  source 1..203: mol_type = other DNA

SEQ ID NO: 30525 - DNA, 203 bp, Homo sapiens; identical to SEQ ID NO: 5964
  source 1..203: mol_type = other DNA

SEQ ID NO: 30526 - DNA, 203 bp, Homo sapiens; identical to SEQ ID NO: 5969
  source 1..203: mol_type = other DNA

SEQ ID NO: 30527 - DNA, 203 bp, Homo sapiens; identical to SEQ ID NO: 5971
  source 1..203: mol_type = other DNA

SEQ ID NO: 30528 - DNA, 203 bp, Homo sapiens; identical to SEQ ID NO: 5989
  source 1..203: mol_type = other DNA

SEQ ID NO: 30529 - DNA, 203 bp, Homo sapiens; identical to SEQ ID NO: 5997
  source 1..203: mol_type = other DNA

SEQ ID NO: 30530 - DNA, 203 bp, Homo sapiens; identical to SEQ ID NO: 5998
  source 1..203: mol_type = other DNA

SEQ ID NO: 30531 - DNA, 203 bp, Homo sapiens; identical to SEQ ID NO: 5999
  source 1..203: mol_type = other DNA

SEQ ID NO: 30532 - DNA, 203 bp, Homo sapiens; identical to SEQ ID NO: 6000
  source 1..203: mol_type = other DNA

SEQ ID NO: 30533 - DNA, 203 bp, Homo sapiens; identical to SEQ ID NO: 6001
  source 1..203: mol_type = other DNA

SEQ ID NO: 30534 - DNA, 203 bp, Homo sapiens; identical to SEQ ID NO: 6002
  source 1..203: mol_type = other DNA

SEQ ID NO: 30535 - DNA, 203 bp, Homo sapiens; identical to SEQ ID NO: 6003
  source 1..203: mol_type = other DNA

SEQ ID NO: 30536 - DNA, 203 bp, Homo sapiens; identical to SEQ ID NO: 6004
  source 1..203: mol_type = other DNA

SEQ ID NO: 30537 - DNA, 203 bp, Homo sapiens; identical to SEQ ID NO: 6005
  source 1..203: mol_type = other DNA

SEQ ID NO: 30538 - DNA, 203 bp, Homo sapiens; identical to SEQ ID NO: 6006
  source 1..203: mol_type = other DNA

SEQ ID NO: 30539 - DNA, 203 bp, Homo sapiens; identical to SEQ ID NO: 6007
  source 1..203: mol_type = other DNA

SEQ ID NO: 30540 - DNA, 203 bp, Homo sapiens; identical to SEQ ID NO: 6053
  source 1..203: mol_type = other DNA

SEQ ID NO: 30541 - DNA, 203 bp, Homo sapiens; identical to SEQ ID NO: 6054
  source 1..203: mol_type = other DNA

SEQ ID NO: 30542 - DNA, 203 bp, Homo sapiens; identical to SEQ ID NO: 6055
  source 1..203: mol_type = other DNA

SEQ ID NO: 30543 - DNA, 203 bp, Homo sapiens; identical to SEQ ID NO: 6056
  source 1..203: mol_type = other DNA

SEQ ID NO: 30544 - DNA, 203 bp, Homo sapiens; identical to SEQ ID NO: 6057
  source 1..203: mol_type = other DNA

SEQ ID NO: 30545 - DNA, 203 bp, Homo sapiens; identical to SEQ ID NO: 6058
  source 1..203: mol_type = other DNA

SEQ ID NO: 30546 - DNA, 203 bp, Homo sapiens; identical to SEQ ID NO: 6059
  source 1..203: mol_type = other DNA

SEQ ID NO: 30547 - DNA, 203 bp, Homo sapiens; identical to SEQ ID NO: 6060
  source 1..203: mol_type = other DNA

SEQ ID NO: 30548 - DNA, 203 bp, Homo sapiens; identical to SEQ ID NO: 6061
  source 1..203: mol_type = other DNA

SEQ ID NO: 30549 - DNA, 203 bp, Homo sapiens; identical to SEQ ID NO: 6062
  source 1..203: mol_type = other DNA

SEQ ID NO: 30550 - DNA, 203 bp, Homo sapiens; identical to SEQ ID NO: 6063
  source 1..203: mol_type = other DNA

SEQ ID NO: 30551 - DNA, 203 bp, Homo sapiens; identical to SEQ ID NO: 6064
  source 1..203: mol_type = other DNA

SEQ ID NO: 30552 - DNA, 203 bp, Homo sapiens; identical to SEQ ID NO: 6065
  source 1..203: mol_type = other DNA

SEQ ID NO: 30553 - DNA, 203 bp, Homo sapiens; identical to SEQ ID NO: 6089
  source 1..203: mol_type = other DNA

SEQ ID NO: 30554 - DNA, 203 bp, Homo sapiens; identical to SEQ ID NO: 6150
  source 1..203: mol_type = other DNA

SEQ ID NO: 30555 - DNA, 203 bp, Homo sapiens; identical to SEQ ID NO: 6164
  source 1..203: mol_type = other DNA

SEQ ID NO: 30556 - DNA, 203 bp, Homo sapiens; identical to SEQ ID NO: 6166
  source 1..203: mol_type = other DNA

SEQ ID NO: 30557 - DNA, 203 bp, Homo sapiens; identical to SEQ ID NO: 6168
  source 1..203: mol_type = other DNA

SEQ ID NO: 30558 - DNA, 203 bp, Homo sapiens; identical to SEQ ID NO: 6169
  source 1..203: mol_type = other DNA

SEQ ID NO: 30559 - DNA, 203 bp, Homo sapiens; identical to SEQ ID NO: 6170
  source 1..203: mol_type = other DNA

SEQ ID NO: 30560 - DNA, 203 bp, Homo sapiens; identical to SEQ ID NO: 6171
  source 1..203: mol_type = other DNA

SEQ ID NO: 30561 - DNA, 203 bp, Homo sapiens; identical to SEQ ID NO: 6172
  source 1..203: mol_type = other DNA

SEQ ID NO: 30562 - DNA, 203 bp, Homo sapiens; identical to SEQ ID NO: 6173
  source 1..203: mol_type = other DNA

SEQ ID NO: 30563 - DNA, 203 bp, Homo sapiens; identical to SEQ ID NO: 6174
  source 1..203: mol_type = other DNA

SEQ ID NO: 30564 - DNA, 203 bp, Homo sapiens; identical to SEQ ID NO: 6225
  source 1..203: mol_type = other DNA

SEQ ID NO: 30565 - DNA, 203 bp, Homo sapiens; identical to SEQ ID NO: 6227
  source 1..203: mol_type = other DNA

SEQ ID NO: 30566 - DNA, 203 bp, Homo sapiens; identical to SEQ ID NO: 6228
  source 1..203: mol_type = other DNA

SEQ ID NO: 30567 - DNA, 203 bp, Homo sapiens; identical to SEQ ID NO: 6229
  source 1..203: mol_type = other DNA

SEQ ID NO: 30568 - DNA, 203 bp, Homo sapiens; identical to SEQ ID NO: 6230
  source 1..203: mol_type = other DNA

SEQ ID NO: 30569 - DNA, 203 bp, Homo sapiens; identical to SEQ ID NO: 6231
  source 1..203: mol_type = other DNA

SEQ ID NO: 30570 - DNA, 203 bp, Homo sapiens; identical to SEQ ID NO: 6232
  source 1..203: mol_type = other DNA

SEQ ID NO: 30571 - DNA, 203 bp, Homo sapiens; identical to SEQ ID NO: 6233
  source 1..203: mol_type = other DNA

SEQ ID NO: 30572 - DNA, 203 bp, Homo sapiens; identical to SEQ ID NO: 6234
  source 1..203: mol_type = other DNA

SEQ ID NO: 30573 - DNA, 203 bp, Homo sapiens; identical to SEQ ID NO: 6235
  source 1..203: mol_type = other DNA

SEQ ID NO: 30574 - DNA, 203 bp, Homo sapiens; identical to SEQ ID NO: 6236
  source 1..203: mol_type = other DNA

SEQ ID NO: 30575 - DNA, 203 bp, Homo sapiens; identical to SEQ ID NO: 6237
  source 1..203: mol_type = other DNA

SEQ ID NO: 30576 - DNA, 203 bp, Homo sapiens; identical to SEQ ID NO: 6238
  source 1..203: mol_type = other DNA

SEQ ID NO: 30577 - DNA, 203 bp, Homo sapiens; identical to SEQ ID NO: 6239
  source 1..203: mol_type = other DNA

SEQ ID NO: 30578 - DNA, 203 bp, Homo sapiens; identical to SEQ ID NO: 6240
  source 1..203: mol_type = other DNA

SEQ ID NO: 30579 - DNA, 203 bp, Homo sapiens; identical to SEQ ID NO: 6241
  source 1..203: mol_type = other DNA

SEQ ID NO: 30580 - DNA, 203 bp, Homo sapiens; identical to SEQ ID NO: 6242
  source 1..203: mol_type = other DNA

SEQ ID NO: 30581 - DNA, 203 bp, Homo sapiens; identical to SEQ ID NO: 6243
  source 1..203: mol_type = other DNA

SEQ ID NO: 30582 - DNA, 203 bp, Homo sapiens; identical to SEQ ID NO: 6244
  source 1..203: mol_type = other DNA

SEQ ID NO: 30583 - DNA, 203 bp, Homo sapiens; identical to SEQ ID NO: 6245
  source 1..203: mol_type = other DNA

SEQ ID NO: 30584 - DNA, 203 bp, Homo sapiens; identical to SEQ ID NO: 6246
  source 1..203: mol_type = other DNA

SEQ ID NO: 30585 - DNA, 203 bp, Homo sapiens; identical to SEQ ID NO: 6248
  source 1..203: mol_type = other DNA

SEQ ID NO: 30586 - DNA, 203 bp, Homo sapiens; identical to SEQ ID NO: 6249
  source 1..203: mol_type = other DNA

SEQ ID NO: 30587 - DNA, 203 bp, Homo sapiens; identical to SEQ ID NO: 6250
  source 1..203: mol_type = other DNA

SEQ ID NO: 30588 - DNA, 203 bp, Homo sapiens; identical to SEQ ID NO: 6251
  source 1..203: mol_type = other DNA

SEQ ID NO: 30589 - DNA, 203 bp, Homo sapiens; identical to SEQ ID NO: 6252
  source 1..203: mol_type = other DNA

SEQ ID NO: 30590 - DNA, 203 bp, Homo sapiens; identical to SEQ ID NO: 6253
  source 1..203: mol_type = other DNA

SEQ ID NO: 30591 - DNA, 203 bp, Homo sapiens; identical to SEQ ID NO: 6254
  source 1..203: mol_type = other DNA

SEQ ID NO: 30592 - DNA, 203 bp, Homo sapiens; identical to SEQ ID NO: 6255
  source 1..203: mol_type = other DNA

SEQ ID NO: 30593 - DNA, 203 bp, Homo sapiens; identical to SEQ ID NO: 6256
  source 1..203: mol_type = other DNA

SEQ ID NO: 30594 - DNA, 203 bp, Homo sapiens; identical to SEQ ID NO: 6257
  source 1..203: mol_type = other DNA

SEQ ID NO: 30595 - DNA, 203 bp, Homo sapiens; identical to SEQ ID NO: 6258
  source 1..203: mol_type = other DNA

SEQ ID NO: 30596 - DNA, 203 bp, Homo sapiens; identical to SEQ ID NO: 6259
  source 1..203: mol_type = other DNA

SEQ ID NO: 30597 - DNA, 203 bp, Homo sapiens; identical to SEQ ID NO: 6260
  source 1..203: mol_type = other DNA

SEQ ID NO: 30598 - DNA, 203 bp, Homo sapiens; identical to SEQ ID NO: 6261
  source 1..203: mol_type = other DNA

SEQ ID NO: 30599 - DNA, 203 bp, Homo sapiens; identical to SEQ ID NO: 6262
  source 1..203: mol_type = other DNA

SEQ ID NO: 30600 - DNA, 203 bp, Homo sapiens; identical to SEQ ID NO: 6263
  source 1..203: mol_type = other DNA

SEQ ID NO: 30601 - DNA, 203 bp, Homo sapiens; identical to SEQ ID NO: 6264
  source 1..203: mol_type = other DNA

SEQ ID NO: 30602 - DNA, 203 bp, Homo sapiens; identical to SEQ ID NO: 6265
  source 1..203: mol_type = other DNA

SEQ ID NO: 30603 - DNA, 203 bp, Homo sapiens; identical to SEQ ID NO: 6266
  source 1..203: mol_type = other DNA

SEQ ID NO: 30604 - DNA, 203 bp, Homo sapiens; identical to SEQ ID NO: 6291
  source 1..203: mol_type = other DNA

SEQ ID NO: 30605 - DNA, 203 bp, Homo sapiens; identical to SEQ ID NO: 6301
  source 1..203: mol_type = other DNA

SEQ ID NO: 30606 - DNA, 203 bp, Homo sapiens; identical to SEQ ID NO: 6302
  source 1..203: mol_type = other DNA

SEQ ID NO: 30607 - DNA, 203 bp, Homo sapiens; identical to SEQ ID NO: 6303
  source 1..203: mol_type = other DNA

SEQ ID NO: 30608 - DNA, 203 bp, Homo sapiens; identical to SEQ ID NO: 6304
  source 1..203: mol_type = other DNA

SEQ ID NO: 30609 - DNA, 203 bp, Homo sapiens; identical to SEQ ID NO: 6305
  source 1..203: mol_type = other DNA

SEQ ID NO: 30610 - DNA, 203 bp, Homo sapiens; identical to SEQ ID NO: 6306
  source 1..203: mol_type = other DNA

SEQ ID NO: 30611 - DNA, 203 bp, Homo sapiens; identical to SEQ ID NO: 6307
  source 1..203: mol_type = other DNA

SEQ ID NO: 30612 - DNA, 203 bp, Homo sapiens; identical to SEQ ID NO: 6308
  source 1..203: mol_type = other DNA

SEQ ID NO: 30613 - DNA, 203 bp, Homo sapiens; identical to SEQ ID NO: 6309
  source 1..203: mol_type = other DNA

SEQ ID NO: 30614 - DNA, 203 bp, Homo sapiens; identical to SEQ ID NO: 6310
  source 1..203: mol_type = other DNA

SEQ ID NO: 30615 - DNA, 203 bp, Homo sapiens; identical to SEQ ID NO: 6311
  source 1..203: mol_type = other DNA

SEQ ID NO: 30616 - DNA, 203 bp, Homo sapiens; identical to SEQ ID NO: 6312
  source 1..203: mol_type = other DNA

SEQ ID NO: 30617 - DNA, 203 bp, Homo sapiens; identical to SEQ ID NO: 6313
  source 1..203: mol_type = other DNA

SEQ ID NO: 30618 - DNA, 203 bp, Homo sapiens; identical to SEQ ID NO: 6314
  source 1..203: mol_type = other DNA

SEQ ID NO: 30619 - DNA, 203 bp, Homo sapiens; identical to SEQ ID NO: 6315
  source 1..203: mol_type = other DNA

SEQ ID NO: 30620 - DNA, 203 bp, Homo sapiens; identical to SEQ ID NO: 6316
  source 1..203: mol_type = other DNA

SEQ ID NO: 30621 - DNA, 203 bp, Homo sapiens; identical to SEQ ID NO: 6317
  source 1..203: mol_type = other DNA

SEQ ID NO: 30622 - DNA, 203 bp, Homo sapiens; identical to SEQ ID NO: 6318
  source 1..203: mol_type = other DNA

SEQ ID NO: 30623 - DNA, 203 bp, Homo sapiens; identical to SEQ ID NO: 6319
  source 1..203: mol_type = other DNA

SEQ ID NO: 30624 - DNA, 203 bp, Homo sapiens; identical to SEQ ID NO: 6320
  source 1..203: mol_type = other DNA

SEQ ID NO: 30625 - DNA, 203 bp, Homo sapiens; identical to SEQ ID NO: 6321
  source 1..203: mol_type = other DNA

SEQ ID NO: 30626 - DNA, 203 bp, Homo sapiens; identical to SEQ ID NO: 6322
  source 1..203: mol_type = other DNA

SEQ ID NO: 30627 - DNA, 203 bp, Homo sapiens; identical to SEQ ID NO: 6323
  source 1..203: mol_type = other DNA

SEQ ID NO: 30628 - DNA, 203 bp, Homo sapiens; identical to SEQ ID NO: 6324
  source 1..203: mol_type = other DNA

SEQ ID NO: 30629 - DNA, 203 bp, Homo sapiens; identical to SEQ ID NO: 6325
  source 1..203: mol_type = other DNA

SEQ ID NO: 30630 - DNA, 203 bp, Homo sapiens; identical to SEQ ID NO: 6326
  source 1..203: mol_type = other DNA

SEQ ID NO: 30631 - DNA, 203 bp, Homo sapiens; identical to SEQ ID NO: 6327
  source 1..203: mol_type = other DNA

SEQ ID NO: 30632 - DNA, 203 bp, Homo sapiens; identical to SEQ ID NO: 6328
  source 1..203: mol_type = other DNA

SEQ ID NO: 30633 - DNA, 203 bp, Homo sapiens; identical to SEQ ID NO: 6329
  source 1..203: mol_type = other DNA

SEQ ID NO: 30634 - DNA, 203 bp, Homo sapiens; identical to SEQ ID NO: 6330
  source 1..203: mol_type = other DNA

SEQ ID NO: 30635 - DNA, 203 bp, Homo sapiens; identical to SEQ ID NO: 6331
  source 1..203: mol_type = other DNA

SEQ ID NO: 30636 - DNA, 203 bp, Homo sapiens; identical to SEQ ID NO: 6332
  source 1..203: mol_type = other DNA

SEQ ID NO: 30637 - DNA, 203 bp, Homo sapiens; identical to SEQ ID NO: 6333
  source 1..203: mol_type = other DNA

SEQ ID NO: 30638 - DNA, 203 bp, Homo sapiens; identical to SEQ ID NO: 6334
  source 1..203: mol_type = other DNA

SEQ ID NO: 30639 - DNA, 203 bp, Homo sapiens; identical to SEQ ID NO: 6335
  source 1..203: mol_type = other DNA

SEQ ID NO: 30640 - DNA, 203 bp, Homo sapiens; identical to SEQ ID NO: 6336
  source 1..203: mol_type = other DNA

SEQ ID NO: 30641 - DNA, 203 bp, Homo sapiens; identical to SEQ ID NO: 6337
  source 1..203: mol_type = other DNA

SEQ ID NO: 30642 - DNA, 203 bp, Homo sapiens; identical to SEQ ID NO: 6338
  source 1..203: mol_type = other DNA

SEQ ID NO: 30643 - DNA, 203 bp, Homo sapiens; identical to SEQ ID NO: 6339
  source 1..203: mol_type = other DNA

SEQ ID NO: 30644 - DNA, 203 bp, Homo sapiens; identical to SEQ ID NO: 6340
  source 1..203: mol_type = other DNA

SEQ ID NO: 30645 - DNA, 203 bp, Homo sapiens; identical to SEQ ID NO: 6341
  source 1..203: mol_type = other DNA

SEQ ID NO: 30646 - DNA, 203 bp, Homo sapiens; identical to SEQ ID NO: 6342
  source 1..203: mol_type = other DNA

SEQ ID NO: 30647 - DNA, 203 bp, Homo sapiens; identical to SEQ ID NO: 6343
  source 1..203: mol_type = other DNA

SEQ ID NO: 30648 - DNA, 203 bp, Homo sapiens; identical to SEQ ID NO: 6344
  source 1..203: mol_type = other DNA

SEQ ID NO: 30649 - DNA, 203 bp, Homo sapiens; identical to SEQ ID NO: 6345
  source 1..203: mol_type = other DNA

SEQ ID NO: 30650 - DNA, 203 bp, Homo sapiens; identical to SEQ ID NO: 6346
  source 1..203: mol_type = other DNA

SEQ ID NO: 30651 - DNA, 203 bp, Homo sapiens; identical to SEQ ID NO: 6347
  source 1..203: mol_type = other DNA

SEQ ID NO: 30652 - DNA, 203 bp, Homo sapiens; identical to SEQ ID NO: 6348
  source 1..203: mol_type = other DNA

SEQ ID NO: 30653 - DNA, 203 bp, Homo sapiens; identical to SEQ ID NO: 6351
  source 1..203: mol_type = other DNA

SEQ ID NO: 30654 - DNA, 203 bp, Homo sapiens; identical to SEQ ID NO: 6373
  source 1..203: mol_type = other DNA

SEQ ID NO: 30655 - DNA, 203 bp, Homo sapiens; identical to SEQ ID NO: 6377
  source 1..203: mol_type = other DNA

SEQ ID NO: 30656 - DNA, 203 bp, Homo sapiens; identical to SEQ ID NO: 6378
  source 1..203: mol_type = other DNA

SEQ ID NO: 30657 - DNA, 203 bp, Homo sapiens; identical to SEQ ID NO: 6379
  source 1..203: mol_type = other DNA

SEQ ID NO: 30658 - DNA, 203 bp, Homo sapiens; identical to SEQ ID NO: 6380
  source 1..203: mol_type = other DNA

SEQ ID NO: 30659 - DNA, 203 bp, Homo sapiens; identical to SEQ ID NO: 6381
  source 1..203: mol_type = other DNA

SEQ ID NO: 30660 - DNA, 203 bp, Homo sapiens; identical to SEQ ID NO: 6382
  source 1..203: mol_type = other DNA

SEQ ID NO: 30661 - DNA, 203 bp, Homo sapiens; identical to SEQ ID NO: 6383
  source 1..203: mol_type = other DNA

SEQ ID NO: 30662 - DNA, 203 bp, Homo sapiens; identical to SEQ ID NO: 6384
  source 1..203: mol_type = other DNA

SEQ ID NO: 30663 - DNA, 203 bp, Homo sapiens; identical to SEQ ID NO: 6385
  source 1..203: mol_type = other DNA

SEQ ID NO: 30664 - DNA, 203 bp, Homo sapiens; identical to SEQ ID NO: 6388
  source 1..203: mol_type = other DNA

SEQ ID NO: 30665 - DNA, 203 bp, Homo sapiens; identical to SEQ ID NO: 6389
  source 1..203: mol_type = other DNA

SEQ ID NO: 30666 - DNA, 203 bp, Homo sapiens; identical to SEQ ID NO: 6390
  source 1..203: mol_type = other DNA

SEQ ID NO: 30667 - DNA, 203 bp, Homo sapiens; identical to SEQ ID NO: 6391
  source 1..203: mol_type = other DNA

SEQ ID NO: 30668 - DNA, 203 bp, Homo sapiens; identical to SEQ ID NO: 6406
  source 1..203: mol_type = other DNA

SEQ ID NO: 30669 - DNA, 203 bp, Homo sapiens; identical to SEQ ID NO: 6407
  source 1..203: mol_type = other DNA

SEQ ID NO: 30670 - DNA, 203 bp, Homo sapiens; identical to SEQ ID NO: 6409
  source 1..203: mol_type = other DNA

SEQ ID NO: 30671 - DNA, 203 bp, Homo sapiens; identical to SEQ ID NO: 6410
  source 1..203: mol_type = other DNA

SEQ ID NO: 30672 - DNA, 203 bp, Homo sapiens; identical to SEQ ID NO: 6411
  source 1..203: mol_type = other DNA

SEQ ID NO: 30673 - DNA, 203 bp, Homo sapiens; identical to SEQ ID NO: 6412
  source 1..203: mol_type = other DNA

SEQ ID NO: 30674 - DNA, 203 bp, Homo sapiens; identical to SEQ ID NO: 6413
  source 1..203: mol_type = other DNA

SEQ ID NO: 30675 - DNA, 203 bp, Homo sapiens; identical to SEQ ID NO: 6414
  source 1..203: mol_type = other DNA

SEQ ID NO: 30676 - DNA, 203 bp, Homo sapiens; identical to SEQ ID NO: 6415
  source 1..203: mol_type = other DNA

SEQ ID NO: 30677 - DNA, 203 bp, Homo sapiens; identical to SEQ ID NO: 6416
  source 1..203: mol_type = other DNA

SEQ ID NO: 30678 - DNA, 203 bp, Homo sapiens; identical to SEQ ID NO: 6417
  source 1..203: mol_type = other DNA

SEQ ID NO: 30679 - DNA, 203 bp, Homo sapiens; identical to SEQ ID NO: 6418
  source 1..203: mol_type = other DNA

SEQ ID NO: 30680 - DNA, 203 bp, Homo sapiens; identical to SEQ ID NO: 6425
  source 1..203: mol_type = other DNA

SEQ ID NO: 30681 - DNA, 203 bp, Homo sapiens; identical to SEQ ID NO: 6426
  source 1..203: mol_type = other DNA

SEQ ID NO: 30682 - DNA, 203 bp, Homo sapiens; identical to SEQ ID NO: 6427
  source 1..203: mol_type = other DNA

SEQ ID NO: 30683 - DNA, 203 bp, Homo sapiens; identical to SEQ ID NO: 6428
  source 1..203: mol_type = other DNA

SEQ ID NO: 30684 - DNA, 203 bp, Homo sapiens; identical to SEQ ID NO: 6429
  source 1..203: mol_type = other DNA

SEQ ID NO: 30685 - DNA, 203 bp, Homo sapiens; identical to SEQ ID NO: 6430
  source 1..203: mol_type = other DNA

SEQ ID NO: 30686 - DNA, 203 bp, Homo sapiens; identical to SEQ ID NO: 6431
  source 1..203: mol_type = other DNA

SEQ ID NO: 30687 - DNA, 203 bp, Homo sapiens; identical to SEQ ID NO: 6432
  source 1..203: mol_type = other DNA

SEQ ID NO: 30688 - DNA, 203 bp, Homo sapiens; identical to SEQ ID NO: 6433
  source 1..203: mol_type = other DNA

SEQ ID NO: 30689 - DNA, 203 bp, Homo sapiens; identical to SEQ ID NO: 6434
  source 1..203: mol_type = other DNA

SEQ ID NO: 30690 - DNA, 203 bp, Homo sapiens; identical to SEQ ID NO: 6437
  source 1..203: mol_type = other DNA

SEQ ID NO: 30691 - DNA, 203 bp, Homo sapiens; identical to SEQ ID NO: 6438
  source 1..203: mol_type = other DNA

SEQ ID NO: 30692 - DNA, 203 bp, Homo sapiens; identical to SEQ ID NO: 6439
  source 1..203: mol_type = other DNA

SEQ ID NO: 30693 - DNA, 203 bp, Homo sapiens; identical to SEQ ID NO: 6440
  source 1..203: mol_type = other DNA

SEQ ID NO: 30694 - DNA, 203 bp, Homo sapiens; identical to SEQ ID NO: 6441
  source 1..203: mol_type = other DNA

SEQ ID NO: 30695 - DNA, 203 bp, Homo sapiens; identical to SEQ ID NO: 6442
  source 1..203: mol_type = other DNA

SEQ ID NO: 30696 - DNA, 203 bp, Homo sapiens; identical to SEQ ID NO: 6443
  source 1..203: mol_type = other DNA

SEQ ID NO: 30697 - DNA, 203 bp, Homo sapiens; identical to SEQ ID NO: 6444
  source 1..203: mol_type = other DNA

SEQ ID NO: 30698 - DNA, 203 bp, Homo sapiens; identical to SEQ ID NO: 6445
  source 1..203: mol_type = other DNA

SEQ ID NO: 30699 - DNA, 203 bp, Homo sapiens; identical to SEQ ID NO: 6446
  source 1..203: mol_type = other DNA

SEQ ID NO: 30700 - DNA, 203 bp, Homo sapiens; identical to SEQ ID NO: 6447
  source 1..203: mol_type = other DNA

SEQ ID NO: 30701 - DNA, 203 bp, Homo sapiens; identical to SEQ ID NO: 6448
  source 1..203: mol_type = other DNA

SEQ ID NO: 30702 - DNA, 203 bp, Homo sapiens; identical to SEQ ID NO: 6449
  source 1..203: mol_type = other DNA

SEQ ID NO: 30703 - DNA, 203 bp, Homo sapiens; identical to SEQ ID NO: 6469
  source 1..203: mol_type = other DNA

SEQ ID NO: 30704 - DNA, 203 bp, Homo sapiens; identical to SEQ ID NO: 6470
  source 1..203: mol_type = other DNA

SEQ ID NO: 30705 - DNA, 203 bp, Homo sapiens; identical to SEQ ID NO: 6471
  source 1..203: mol_type = other DNA

SEQ ID NO: 30706 - DNA, 203 bp, Homo sapiens; identical to SEQ ID NO: 6472
  source 1..203: mol_type = other DNA

SEQ ID NO: 30707 - DNA, 203 bp, Homo sapiens; identical to SEQ ID NO: 6473
  source 1..203: mol_type = other DNA

SEQ ID NO: 30708 - DNA, 203 bp, Homo sapiens; identical to SEQ ID NO: 6474
  source 1..203: mol_type = other DNA

SEQ ID NO: 30709 - DNA, 203 bp, Homo sapiens; identical to SEQ ID NO: 6475
  source 1..203: mol_type = other DNA

SEQ ID NO: 30710 - DNA, 203 bp, Homo sapiens; identical to SEQ ID NO: 6476
  source 1..203: mol_type = other DNA

SEQ ID NO: 30711 - DNA, 203 bp, Homo sapiens; identical to SEQ ID NO: 6477
  source 1..203: mol_type = other DNA

SEQ ID NO: 30712 - DNA, 203 bp, Homo sapiens; identical to SEQ ID NO: 6478
  source 1..203: mol_type = other DNA

SEQ ID NO: 30713 - DNA, 203 bp, Homo sapiens; identical to SEQ ID NO: 6479
  source 1..203: mol_type = other DNA

SEQ ID NO: 30714 - DNA, 203 bp, Homo sapiens; identical to SEQ ID NO: 6480
  source 1..203: mol_type = other DNA

SEQ ID NO: 30715 - DNA, 203 bp, Homo sapiens; identical to SEQ ID NO: 6481
  source 1..203: mol_type = other DNA

SEQ ID NO: 30716 - DNA, 203 bp, Homo sapiens; identical to SEQ ID NO: 6537
  source 1..203: mol_type = other DNA

SEQ ID NO: 30717 - DNA, 203 bp, Homo sapiens; identical to SEQ ID NO: 6545
  source 1..203: mol_type = other DNA

SEQ ID NO: 30718 - DNA, 203 bp, Homo sapiens; identical to SEQ ID NO: 6553
  source 1..203: mol_type = other DNA

SEQ ID NO: 30719 - DNA, 203 bp, Homo sapiens; identical to SEQ ID NO: 6554
  source 1..203: mol_type = other DNA

SEQ ID NO: 30720 - DNA, 203 bp, Homo sapiens; identical to SEQ ID NO: 6555
  source 1..203: mol_type = other DNA

SEQ ID NO: 30721 - DNA, 203 bp, Homo sapiens; identical to SEQ ID NO: 6556
  source 1..203: mol_type = other DNA

SEQ ID NO: 30722 - DNA, 203 bp, Homo sapiens; identical to SEQ ID NO: 6557
  source 1..203: mol_type = other DNA

SEQ ID NO: 30723 - DNA, 203 bp, Homo sapiens; identical to SEQ ID NO: 6558
  source 1..203: mol_type = other DNA

SEQ ID NO: 30724 - DNA, 203 bp, Homo sapiens; identical to SEQ ID NO: 6559
  source 1..203: mol_type = other DNA

SEQ ID NO: 30725 - DNA, 203 bp, Homo sapiens; identical to SEQ ID NO: 6560
  source 1..203: mol_type = other DNA

SEQ ID NO: 30726 - DNA, 203 bp, Homo sapiens; identical to SEQ ID NO: 6561
  source 1..203: mol_type = other DNA

SEQ ID NO: 30727 - DNA, 203 bp, Homo sapiens; identical to SEQ ID NO: 6562
  source 1..203: mol_type = other DNA

SEQ ID NO: 30728 - DNA, 203 bp, Homo sapiens; identical to SEQ ID NO: 6563
  source 1..203: mol_type = other DNA

SEQ ID NO: 30729 - DNA, 203 bp, Homo sapiens; identical to SEQ ID NO: 6564
  source 1..203: mol_type = other DNA

SEQ ID NO: 30730 - DNA, 203 bp, Homo sapiens; identical to SEQ ID NO: 6565
  source 1..203: mol_type = other DNA

SEQ ID NO: 30731 - DNA, 203 bp, Homo sapiens; identical to SEQ ID NO: 6566
  source 1..203: mol_type = other DNA

SEQ ID NO: 30732 - DNA, 203 bp, Homo sapiens; identical to SEQ ID NO: 6568
  source 1..203: mol_type = other DNA

SEQ ID NO: 30733 - DNA, 203 bp, Homo sapiens; identical to SEQ ID NO: 6573
  source 1..203: mol_type = other DNA

SEQ ID NO: 30734 - DNA, 203 bp, Homo sapiens; identical to SEQ ID NO: 6574
  source 1..203: mol_type = other DNA

SEQ ID NO: 30735 - DNA, 203 bp, Homo sapiens; identical to SEQ ID NO: 6592
  source 1..203: mol_type = other DNA

SEQ ID NO: 30736 - DNA, 203 bp, Homo sapiens; identical to SEQ ID NO: 6595
  source 1..203: mol_type = other DNA

SEQ ID NO: 30737 - DNA, 203 bp, Homo sapiens; identical to SEQ ID NO: 6596
  source 1..203: mol_type = other DNA

SEQ ID NO: 30738 - DNA, 203 bp, Homo sapiens; identical to SEQ ID NO: 6597
  source 1..203: mol_type = other DNA

SEQ ID NO: 30739 - DNA, 203 bp, Homo sapiens; identical to SEQ ID NO: 6598
  source 1..203: mol_type = other DNA

SEQ ID NO: 30740 - DNA, 203 bp, Homo sapiens; identical to SEQ ID NO: 6599
  source 1..203: mol_type = other DNA

SEQ ID NO: 30741 - DNA, 203 bp, Homo sapiens; identical to SEQ ID NO: 6600
  source 1..203: mol_type = other DNA

SEQ ID NO: 30742 - DNA, 203 bp, Homo sapiens; identical to SEQ ID NO: 6601
  source 1..203: mol_type = other DNA

SEQ ID NO: 30743 - DNA, 203 bp, Homo sapiens; identical to SEQ ID NO: 6602
  source 1..203: mol_type = other DNA

SEQ ID NO: 30744 - DNA, 203 bp, Homo sapiens; identical to SEQ ID NO: 6603
  source 1..203: mol_type = other DNA

SEQ ID NO: 30745 - DNA, 203 bp, Homo sapiens; identical to SEQ ID NO: 6604
  source 1..203: mol_type = other DNA

SEQ ID NO: 30746 - DNA, 203 bp, Homo sapiens; identical to SEQ ID NO: 6605
  source 1..203: mol_type = other DNA

SEQ ID NO: 30747 - DNA, 203 bp, Homo sapiens; identical to SEQ ID NO: 6606
  source 1..203: mol_type = other DNA

SEQ ID NO: 30748 - DNA, 203 bp, Homo sapiens; identical to SEQ ID NO: 6607
  source 1..203: mol_type = other DNA

SEQ ID NO: 30749 - DNA, 203 bp, Homo sapiens; identical to SEQ ID NO: 6608
  source 1..203: mol_type = other DNA

SEQ ID NO: 30750 - DNA, 203 bp, Homo sapiens; identical to SEQ ID NO: 6609
  source 1..203: mol_type = other DNA

SEQ ID NO: 30751 - DNA, 203 bp, Homo sapiens; identical to SEQ ID NO: 6610
  source 1..203: mol_type = other DNA

SEQ ID NO: 30752 - DNA, 203 bp, Homo sapiens; identical to SEQ ID NO: 6611
  source 1..203: mol_type = other DNA

SEQ ID NO: 30753 - DNA, 203 bp, Homo sapiens; identical to SEQ ID NO: 6612
  source 1..203: mol_type = other DNA

SEQ ID NO: 30754 - DNA, 203 bp, Homo sapiens; identical to SEQ ID NO: 6613
  source 1..203: mol_type = other DNA

SEQ ID NO: 30755 - DNA, 203 bp, Homo sapiens; identical to SEQ ID NO: 6614
  source 1..203: mol_type = other DNA

SEQ ID NO: 30756 - DNA, 203 bp, Homo sapiens; identical to SEQ ID NO: 6617
  source 1..203: mol_type = other DNA

SEQ ID NO: 30757 - DNA, 203 bp, Homo sapiens; identical to SEQ ID NO: 6618
  source 1..203: mol_type = other DNA

SEQ ID NO: 30758 - DNA, 203 bp, Homo sapiens; identical to SEQ ID NO: 6620
  source 1..203: mol_type = other DNA

SEQ ID NO: 30759 - DNA, 203 bp, Homo sapiens; identical to SEQ ID NO: 6621
  source 1..203: mol_type = other DNA

SEQ ID NO: 30760 - DNA, 203 bp, Homo sapiens; identical to SEQ ID NO: 6622
  source 1..203: mol_type = other DNA

SEQ ID NO: 30761 - DNA, 203 bp, Homo sapiens; identical to SEQ ID NO: 6639
  source 1..203: mol_type = other DNA

SEQ ID NO: 30762 - DNA, 203 bp, Homo sapiens; identical to SEQ ID NO: 6642
  source 1..203: mol_type = other DNA

SEQ ID NO: 30763 - DNA, 203 bp, Homo sapiens; identical to SEQ ID NO: 6645
  source 1..203: mol_type = other DNA

SEQ ID NO: 30764 - DNA, 203 bp, Homo sapiens; identical to SEQ ID NO: 6662
  source 1..203: mol_type = other DNA

SEQ ID NO: 30765 - DNA, 203 bp, Homo sapiens; identical to SEQ ID NO: 6671
  source 1..203: mol_type = other DNA

SEQ ID NO: 30766 - DNA, 203 bp, Homo sapiens; identical to SEQ ID NO: 6672
  source 1..203: mol_type = other DNA

SEQ ID NO: 30767 - DNA, 203 bp, Homo sapiens; identical to SEQ ID NO: 6673
  source 1..203: mol_type = other DNA

SEQ ID NO: 30768 - DNA, 203 bp, Homo sapiens; identical to SEQ ID NO: 6674
  source 1..203: mol_type = other DNA

SEQ ID NO: 30769 - DNA, 203 bp, Homo sapiens; identical to SEQ ID NO: 6675
  source 1..203: mol_type = other DNA

SEQ ID NO: 30770 - DNA, 203 bp, Homo sapiens; identical to SEQ ID NO: 6687
  source 1..203: mol_type = other DNA

SEQ ID NO: 30771 - DNA, 203 bp, Homo sapiens; identical to SEQ ID NO: 6689
  source 1..203: mol_type = other DNA

SEQ ID NO: 30772 - DNA, 203 bp, Homo sapiens; identical to SEQ ID NO: 6690
  source 1..203: mol_type = other DNA

SEQ ID NO: 30773 - DNA, 203 bp, Homo sapiens; identical to SEQ ID NO: 6691
  source 1..203: mol_type = other DNA

SEQ ID NO: 30774 - DNA, 203 bp, Homo sapiens; identical to SEQ ID NO: 6692
  source 1..203: mol_type = other DNA

SEQ ID NO: 30775 - DNA, 203 bp, Homo sapiens; identical to SEQ ID NO: 6693
  source 1..203: mol_type = other DNA

SEQ ID NO: 30776 - DNA, 203 bp, Homo sapiens; identical to SEQ ID NO: 6694
  source 1..203: mol_type = other DNA

SEQ ID NO: 30777 - DNA, 203 bp, Homo sapiens; identical to SEQ ID NO: 6695
  source 1..203: mol_type = other DNA

SEQ ID NO: 30778 - DNA, 203 bp, Homo sapiens; identical to SEQ ID NO: 6696
  source 1..203: mol_type = other DNA

SEQ ID NO: 30779 - DNA, 203 bp, Homo sapiens; identical to SEQ ID NO: 6697
  source 1..203: mol_type = other DNA

SEQ ID NO: 30780 - DNA, 203 bp, Homo sapiens; identical to SEQ ID NO: 6698
  source 1..203: mol_type = other DNA

SEQ ID NO: 30781 - DNA, 203 bp, Homo sapiens; identical to SEQ ID NO: 6699
  source 1..203: mol_type = other DNA

SEQ ID NO: 30782 - DNA, 203 bp, Homo sapiens; identical to SEQ ID NO: 6700
  source 1..203: mol_type = other DNA

SEQ ID NO: 30783 - DNA, 203 bp, Homo sapiens; identical to SEQ ID NO: 6701
  source 1..203: mol_type = other DNA

SEQ ID NO: 30784 - DNA, 203 bp, Homo sapiens; identical to SEQ ID NO: 6702
  source 1..203: mol_type = other DNA

SEQ ID NO: 30785 - DNA, 203 bp, Homo sapiens; identical to SEQ ID NO: 6703
  source 1..203: mol_type = other DNA

SEQ ID NO: 30786 - DNA, 203 bp, Homo sapiens; identical to SEQ ID NO: 6704
  source 1..203: mol_type = other DNA

SEQ ID NO: 30787 - DNA, 203 bp, Homo sapiens; identical to SEQ ID NO: 6705
  source 1..203: mol_type = other DNA

SEQ ID NO: 30788 - DNA, 203 bp, Homo sapiens; identical to SEQ ID NO: 6706
  source 1..203: mol_type = other DNA

SEQ ID NO: 30789 - DNA, 203 bp, Homo sapiens; identical to SEQ ID NO: 6707
  source 1..203: mol_type = other DNA

SEQ ID NO: 30790 - DNA, 203 bp, Homo sapiens; identical to SEQ ID NO: 6708
  source 1..203: mol_type = other DNA

SEQ ID NO: 30791 - DNA, 203 bp, Homo sapiens; identical to SEQ ID NO: 6709
  source 1..203: mol_type = other DNA

SEQ ID NO: 30792 - DNA, 203 bp, Homo sapiens; identical to SEQ ID NO: 6710
  source 1..203: mol_type = other DNA

SEQ ID NO: 30793 - DNA, 203 bp, Homo sapiens; identical to SEQ ID NO: 6711
  source 1..203: mol_type = other DNA

SEQ ID NO: 30794 - DNA, 203 bp, Homo sapiens; identical to SEQ ID NO: 6712
  source 1..203: mol_type = other DNA

SEQ ID NO: 30795 - DNA, 203 bp, Homo sapiens; identical to SEQ ID NO: 6713
  source 1..203: mol_type = other DNA

SEQ ID NO: 30796 - DNA, 203 bp, Homo sapiens; identical to SEQ ID NO: 6714
  source 1..203: mol_type = other DNA

SEQ ID NO: 30797 - DNA, 203 bp, Homo sapiens; identical to SEQ ID NO: 6715
  source 1..203: mol_type = other DNA

SEQ ID NO: 30798 - DNA, 203 bp, Homo sapiens; identical to SEQ ID NO: 6716
  source 1..203: mol_type = other DNA

SEQ ID NO: 30799 - DNA, 203 bp, Homo sapiens; identical to SEQ ID NO: 6717
  source 1..203: mol_type = other DNA

SEQ ID NO: 30800 - DNA, 203 bp, Homo sapiens; identical to SEQ ID NO: 6718
  source 1..203: mol_type = other DNA

SEQ ID NO: 30801 - DNA, 203 bp, Homo sapiens; identical to SEQ ID NO: 6719
  source 1..203: mol_type = other DNA

SEQ ID NO: 30802 - DNA, 203 bp, Homo sapiens; identical to SEQ ID NO: 6728
  source 1..203: mol_type = other DNA

SEQ ID NO: 30803 - DNA, 203 bp, Homo sapiens; identical to SEQ ID NO: 6729
  source 1..203: mol_type = other DNA

SEQ ID NO: 30804 - DNA, 203 bp, Homo sapiens; identical to SEQ ID NO: 6730
  source 1..203: mol_type = other DNA

SEQ ID NO: 30805 - DNA, 203 bp, Homo sapiens; identical to SEQ ID NO: 6731
  source 1..203: mol_type = other DNA

SEQ ID NO: 30806 - DNA, 203 bp, Homo sapiens; identical to SEQ ID NO: 6732
  source 1..203: mol_type = other DNA

SEQ ID NO: 30807 - DNA, 203 bp, Homo sapiens; identical to SEQ ID NO: 6738
  source 1..203: mol_type = other DNA

SEQ ID NO: 30808 - DNA, 203 bp, Homo sapiens; identical to SEQ ID NO: 6740
  source 1..203: mol_type = other DNA

SEQ ID NO: 30809 - DNA, 203 bp, Homo sapiens; identical to SEQ ID NO: 6746
  source 1..203: mol_type = other DNA

SEQ ID NO: 30810 - DNA, 203 bp, Homo sapiens; identical to SEQ ID NO: 6747
  source 1..203: mol_type = other DNA

SEQ ID NO: 30811 - DNA, 203 bp, Homo sapiens; identical to SEQ ID NO: 6773
  source 1..203: mol_type = other DNA

SEQ ID NO: 30812 - DNA, 203 bp, Homo sapiens; identical to SEQ ID NO: 6774
  source 1..203: mol_type = other DNA

SEQ ID NO: 30813 - DNA, 203 bp, Homo sapiens; identical to SEQ ID NO: 6775
  source 1..203: mol_type = other DNA

SEQ ID NO: 30814 - DNA, 203 bp, Homo sapiens; identical to SEQ ID NO: 6776
  source 1..203: mol_type = other DNA

SEQ ID NO: 30815 - DNA, 203 bp, Homo sapiens; identical to SEQ ID NO: 6777
  source 1..203: mol_type = other DNA

SEQ ID NO: 30816 - DNA, 203 bp, Homo sapiens; identical to SEQ ID NO: 6778
  source 1..203: mol_type = other DNA

SEQ ID NO: 30817 - DNA, 203 bp, Homo sapiens; identical to SEQ ID NO: 6779
  source 1..203: mol_type = other DNA

SEQ ID NO: 30818 - DNA, 203 bp, Homo sapiens; identical to SEQ ID NO: 6780
  source 1..203: mol_type = other DNA

SEQ ID NO: 30819 - DNA, 203 bp, Homo sapiens; identical to SEQ ID NO: 6781
  source 1..203: mol_type = other DNA

SEQ ID NO: 30820 - DNA, 203 bp, Homo sapiens; identical to SEQ ID NO: 6782
  source 1..203: mol_type = other DNA

SEQ ID NO: 30821 - DNA, 203 bp, Homo sapiens; identical to SEQ ID NO: 6783
  source 1..203: mol_type = other DNA

SEQ ID NO: 30822 - DNA, 203 bp, Homo sapiens; identical to SEQ ID NO: 6784
  source 1..203: mol_type = other DNA

SEQ ID NO: 30823 - DNA, 203 bp, Homo sapiens; identical to SEQ ID NO: 6785
  source 1..203: mol_type = other DNA

SEQ ID NO: 30824 - DNA, 203 bp, Homo sapiens; identical to SEQ ID NO: 6786
  source 1..203: mol_type = other DNA

SEQ ID NO: 30825 - DNA, 203 bp, Homo sapiens; identical to SEQ ID NO: 6794
  source 1..203: mol_type = other DNA

SEQ ID NO: 30826 - DNA, 203 bp, Homo sapiens; identical to SEQ ID NO: 6799
  source 1..203: mol_type = other DNA

SEQ ID NO: 30827 - DNA, 203 bp, Homo sapiens; identical to SEQ ID NO: 6800
  source 1..203: mol_type = other DNA

SEQ ID NO: 30828 - DNA, 203 bp, Homo sapiens; identical to SEQ ID NO: 6801
  source 1..203: mol_type = other DNA

SEQ ID NO: 30829 - DNA, 203 bp, Homo sapiens; identical to SEQ ID NO: 6802
  source 1..203: mol_type = other DNA

SEQ ID NO: 30830 - DNA, 203 bp, Homo sapiens; identical to SEQ ID NO: 6803
  source 1..203: mol_type = other DNA

SEQ ID NO: 30831 - DNA, 203 bp, Homo sapiens; identical to SEQ ID NO: 6809
  source 1..203: mol_type = other DNA

SEQ ID NO: 30832 - DNA, 203 bp, Homo sapiens; identical to SEQ ID NO: 6810
  source 1..203: mol_type = other DNA

SEQ ID NO: 30833 - DNA, 203 bp, Homo sapiens; identical to SEQ ID NO: 6823
  source 1..203: mol_type = other DNA

SEQ ID NO: 30834 - DNA, 203 bp, Homo sapiens; identical to SEQ ID NO: 6827
  source 1..203: mol_type = other DNA

SEQ ID NO: 30835 - DNA, 203 bp, Homo sapiens; identical to SEQ ID NO: 6839
  source 1..203: mol_type = other DNA

SEQ ID NO: 30836 - DNA, 203 bp, Homo sapiens; identical to SEQ ID NO: 6841
  source 1..203: mol_type = other DNA

SEQ ID NO: 30837 - DNA, 203 bp, Homo sapiens; identical to SEQ ID NO: 6842
  source 1..203: mol_type = other DNA

SEQ ID NO: 30838 - DNA, 203 bp, Homo sapiens; identical to SEQ ID NO: 6843
  source 1..203: mol_type = other DNA

SEQ ID NO: 30839 - DNA, 203 bp, Homo sapiens; identical to SEQ ID NO: 6844
  source 1..203: mol_type = other DNA

SEQ ID NO: 30840 - DNA, 203 bp, Homo sapiens; identical to SEQ ID NO: 6845
  source 1..203: mol_type = other DNA

SEQ ID NO: 30841 - DNA, 203 bp, Homo sapiens; identical to SEQ ID NO: 6846
  source 1..203: mol_type = other DNA

SEQ ID NO: 30842 - DNA, 203 bp, Homo sapiens; identical to SEQ ID NO: 6847
  source 1..203: mol_type = other DNA

SEQ ID NO: 30843 - DNA, 203 bp, Homo sapiens; identical to SEQ ID NO: 6848
  source 1..203: mol_type = other DNA

SEQ ID NO: 30844 - DNA, 203 bp, Homo sapiens; identical to SEQ ID NO: 6849
  source 1..203: mol_type = other DNA

SEQ ID NO: 30845 - DNA, 203 bp, Homo sapiens; identical to SEQ ID NO: 6850
  source 1..203: mol_type = other DNA

SEQ ID NO: 30846 - DNA, 203 bp, Homo sapiens; identical to SEQ ID NO: 6851
  source 1..203: mol_type = other DNA

SEQ ID NO: 30847 - DNA, 203 bp, Homo sapiens; identical to SEQ ID NO: 6852
  source 1..203: mol_type = other DNA

SEQ ID NO: 30848 - DNA, 203 bp, Homo sapiens; identical to SEQ ID NO: 6853
  source 1..203: mol_type = other DNA

SEQ ID NO: 30849 - DNA, 203 bp, Homo sapiens; identical to SEQ ID NO: 6854
  source 1..203: mol_type = other DNA

SEQ ID NO: 30850 - DNA, 203 bp, Homo sapiens; identical to SEQ ID NO: 6855
  source 1..203: mol_type = other DNA

SEQ ID NO: 30851 - DNA, 203 bp, Homo sapiens; identical to SEQ ID NO: 6856
  source 1..203: mol_type = other DNA

SEQ ID NO: 30852 - DNA, 203 bp, Homo sapiens; identical to SEQ ID NO: 6857
  source 1..203: mol_type = other DNA

SEQ ID NO: 30853 - DNA, 203 bp, Homo sapiens; identical to SEQ ID NO: 6858
  source 1..203: mol_type = other DNA

SEQ ID NO: 30854 - DNA, 203 bp, Homo sapiens; identical to SEQ ID NO: 6863
  source 1..203: mol_type = other DNA

SEQ ID NO: 30855 - DNA, 203 bp, Homo sapiens; identical to SEQ ID NO: 6864
  source 1..203: mol_type = other DNA

SEQ ID NO: 30856 - DNA, 203 bp, Homo sapiens; identical to SEQ ID NO: 6865
  source 1..203: mol_type = other DNA

SEQ ID NO: 30857 - DNA, 203 bp, Homo sapiens; identical to SEQ ID NO: 6866
  source 1..203: mol_type = other DNA

SEQ ID NO: 30858 - DNA, 203 bp, Homo sapiens; identical to SEQ ID NO: 6867
  source 1..203: mol_type = other DNA

SEQ ID NO: 30859 - DNA, 203 bp, Homo sapiens; identical to SEQ ID NO: 6868
  source 1..203: mol_type = other DNA

SEQ ID NO: 30860 - DNA, 203 bp, Homo sapiens; identical to SEQ ID NO: 6869
  source 1..203: mol_type = other DNA

SEQ ID NO: 30861 - DNA, 203 bp, Homo sapiens; identical to SEQ ID NO: 6870
  source 1..203: mol_type = other DNA

SEQ ID NO: 30862 - DNA, 203 bp, Homo sapiens; identical to SEQ ID NO: 6871
  source 1..203: mol_type = other DNA

SEQ ID NO: 30863 - DNA, 203 bp, Homo sapiens; identical to SEQ ID NO: 6872
  source 1..203: mol_type = other DNA

SEQ ID NO: 30864 - DNA, 203 bp, Homo sapiens; identical to SEQ ID NO: 6873
  source 1..203: mol_type = other DNA

SEQ ID NO: 30865 - DNA, 203 bp, Homo sapiens; identical to SEQ ID NO: 6874
  source 1..203: mol_type = other DNA

SEQ ID NO: 30866 - DNA, 203 bp, Homo sapiens; identical to SEQ ID NO: 6875
  source 1..203: mol_type = other DNA

SEQ ID NO: 30867 - DNA, 203 bp, Homo sapiens; identical to SEQ ID NO: 6876
  source 1..203: mol_type = other DNA

SEQ ID NO: 30868 - DNA, 203 bp, Homo sapiens; identical to SEQ ID NO: 6877
  source 1..203: mol_type = other DNA

SEQ ID NO: 30869 - DNA, 203 bp, Homo sapiens; identical to SEQ ID NO: 6878
  source 1..203: mol_type = other DNA

SEQ ID NO: 30870 - DNA, 203 bp, Homo sapiens; identical to SEQ ID NO: 6879
  source 1..203: mol_type = other DNA

SEQ ID NO: 30871 - DNA, 203 bp, Homo sapiens; identical to SEQ ID NO: 6880
  source 1..203: mol_type = other DNA

SEQ ID NO: 30872 - DNA, 203 bp, Homo sapiens; identical to SEQ ID NO: 6881
  source 1..203: mol_type = other DNA

SEQ ID NO: 30873 - DNA, 203 bp, Homo sapiens; identical to SEQ ID NO: 6882
  source 1..203: mol_type = other DNA

SEQ ID NO: 30874 - DNA, 203 bp, Homo sapiens; identical to SEQ ID NO: 6884
  source 1..203: mol_type = other DNA

SEQ ID NO: 30875 - DNA, 203 bp, Homo sapiens; identical to SEQ ID NO: 6885
  source 1..203: mol_type = other DNA

SEQ ID NO: 30876 - DNA, 203 bp, Homo sapiens; identical to SEQ ID NO: 6886
  source 1..203: mol_type = other DNA

SEQ ID NO: 30877 - DNA, 203 bp, Homo sapiens; identical to SEQ ID NO: 6887
  source 1..203: mol_type = other DNA

SEQ ID NO: 30878 - DNA, 203 bp, Homo sapiens; identical to SEQ ID NO: 6888
  source 1..203: mol_type = other DNA

SEQ ID NO: 30879 - DNA, 203 bp, Homo sapiens; identical to SEQ ID NO: 6889
  source 1..203: mol_type = other DNA

SEQ ID NO: 30880 - DNA, 203 bp, Homo sapiens; identical to SEQ ID NO: 6890
  source 1..203: mol_type = other DNA

SEQ ID NO: 30881 - DNA, 203 bp, Homo sapiens; identical to SEQ ID NO: 6891
  source 1..203: mol_type = other DNA

SEQ ID NO: 30882 - DNA, 203 bp, Homo sapiens; identical to SEQ ID NO: 6892
  source 1..203: mol_type = other DNA

SEQ ID NO: 30883 - DNA, 203 bp, Homo sapiens; identical to SEQ ID NO: 6893
  source 1..203: mol_type = other DNA

SEQ ID NO: 30884 - DNA, 203 bp, Homo sapiens; identical to SEQ ID NO: 6894
  source 1..203: mol_type = other DNA

SEQ ID NO: 30885 - DNA, 203 bp, Homo sapiens; identical to SEQ ID NO: 6895
  source 1..203: mol_type = other DNA

SEQ ID NO: 30886 - DNA, 203 bp, Homo sapiens; identical to SEQ ID NO: 6896
  source 1..203: mol_type = other DNA

SEQ ID NO: 30887 - DNA, 203 bp, Homo sapiens; identical to SEQ ID NO: 6897
  source 1..203: mol_type = other DNA

SEQ ID NO: 30888 - DNA, 203 bp, Homo sapiens; identical to SEQ ID NO: 6898
  source 1..203: mol_type = other DNA

SEQ ID NO: 30889 - DNA, 203 bp, Homo sapiens; identical to SEQ ID NO: 6899
  source 1..203: mol_type = other DNA

SEQ ID NO: 30890 - DNA, 203 bp, Homo sapiens; identical to SEQ ID NO: 6900
  source 1..203: mol_type = other DNA

SEQ ID NO: 30891 - DNA, 203 bp, Homo sapiens; identical to SEQ ID NO: 6901
  source 1..203: mol_type = other DNA

SEQ ID NO: 30892 - DNA, 203 bp, Homo sapiens; identical to SEQ ID NO: 6902
  source 1..203: mol_type = other DNA

SEQ ID NO: 30893 - DNA, 203 bp, Homo sapiens; identical to SEQ ID NO: 6903
  source 1..203: mol_type = other DNA

SEQ ID NO: 30894 - DNA, 203 bp, Homo sapiens; identical to SEQ ID NO: 6904
  source 1..203: mol_type = other DNA

SEQ ID NO: 30895 - DNA, 203 bp, Homo sapiens; identical to SEQ ID NO: 6905
  source 1..203: mol_type = other DNA

SEQ ID NO: 30896 - DNA, 203 bp, Homo sapiens; identical to SEQ ID NO: 6906
  source 1..203: mol_type = other DNA

SEQ ID NO: 30897 - DNA, 203 bp, Homo sapiens; identical to SEQ ID NO: 6907
  source 1..203: mol_type = other DNA

SEQ ID NO: 30898 - DNA, 203 bp, Homo sapiens; identical to SEQ ID NO: 6908
  source 1..203: mol_type = other DNA

SEQ ID NO: 30899 - DNA, 203 bp, Homo sapiens; identical to SEQ ID NO: 6909
  source 1..203: mol_type = other DNA

SEQ ID NO: 30900 - DNA, 203 bp, Homo sapiens; identical to SEQ ID NO: 6913
  source 1..203: mol_type = other DNA

SEQ ID NO: 30901 - DNA, 203 bp, Homo sapiens; identical to SEQ ID NO: 6914
  source 1..203: mol_type = other DNA

SEQ ID NO: 30902 - DNA, 203 bp, Homo sapiens; identical to SEQ ID NO: 6915
  source 1..203: mol_type = other DNA

SEQ ID NO: 30903 - DNA, 203 bp, Homo sapiens; identical to SEQ ID NO: 6916
  source 1..203: mol_type = other DNA

SEQ ID NO: 30904 - DNA, 203 bp, Homo sapiens; identical to SEQ ID NO: 6917
  source 1..203: mol_type = other DNA

SEQ ID NO: 30905 - DNA, 203 bp, Homo sapiens; identical to SEQ ID NO: 6918
  source 1..203: mol_type = other DNA

SEQ ID NO: 30906 - DNA, 203 bp, Homo sapiens; identical to SEQ ID NO: 6919
  source 1..203: mol_type = other DNA

SEQ ID NO: 30907 - DNA, 203 bp, Homo sapiens; identical to SEQ ID NO: 6920
  source 1..203: mol_type = other DNA

SEQ ID NO: 30908 - DNA, 203 bp, Homo sapiens; identical to SEQ ID NO: 6921
  source 1..203: mol_type = other DNA

SEQ ID NO: 30909 - DNA, 203 bp, Homo sapiens; identical to SEQ ID NO: 6922
  source 1..203: mol_type = other DNA

SEQ ID NO: 30910 - DNA, 203 bp, Homo sapiens; identical to SEQ ID NO: 6923
  source 1..203: mol_type = other DNA

SEQ ID NO: 30911 - DNA, 203 bp, Homo sapiens; identical to SEQ ID NO: 6924
  source 1..203: mol_type = other DNA

SEQ ID NO: 30912 - DNA, 203 bp, Homo sapiens; identical to SEQ ID NO: 6925
  source 1..203: mol_type = other DNA

SEQ ID NO: 30913 - DNA, 203 bp, Homo sapiens; identical to SEQ ID NO: 6926
  source 1..203: mol_type = other DNA

SEQ ID NO: 30914 - DNA, 203 bp, Homo sapiens; identical to SEQ ID NO: 6927
  source 1..203: mol_type = other DNA

SEQ ID NO: 30915 - DNA, 203 bp, Homo sapiens; identical to SEQ ID NO: 6943
  source 1..203: mol_type = other DNA

SEQ ID NO: 30916 - DNA, 203 bp, Homo sapiens; identical to SEQ ID NO: 6944
  source 1..203: mol_type = other DNA

SEQ ID NO: 30917 - DNA, 203 bp, Homo sapiens; identical to SEQ ID NO: 6945
  source 1..203: mol_type = other DNA

SEQ ID NO: 30918 - DNA, 203 bp, Homo sapiens; identical to SEQ ID NO: 6946
  source 1..203: mol_type = other DNA

SEQ ID NO: 30919 - DNA, 203 bp, Homo sapiens; identical to SEQ ID NO: 6947
  source 1..203: mol_type = other DNA

SEQ ID NO: 30920 - DNA, 203 bp, Homo sapiens; identical to SEQ ID NO: 6948
  source 1..203: mol_type = other DNA

SEQ ID NO: 30921 - DNA, 203 bp, Homo sapiens; identical to SEQ ID NO: 6949
  source 1..203: mol_type = other DNA

SEQ ID NO: 30922 - DNA, 203 bp, Homo sapiens; identical to SEQ ID NO: 6950
  source 1..203: mol_type = other DNA

SEQ ID NO: 30923 - DNA, 203 bp, Homo sapiens; identical to SEQ ID NO: 6976
  source 1..203: mol_type = other DNA

SEQ ID NO: 30924 - DNA, 203 bp, Homo sapiens; identical to SEQ ID NO: 6977
  source 1..203: mol_type = other DNA

SEQ ID NO: 30925 - DNA, 203 bp, Homo sapiens; identical to SEQ ID NO: 6978
  source 1..203: mol_type = other DNA

SEQ ID NO: 30926 - DNA, 203 bp, Homo sapiens; identical to SEQ ID NO: 6979
  source 1..203: mol_type = other DNA

SEQ ID NO: 30927 - DNA, 203 bp, Homo sapiens; identical to SEQ ID NO: 6980
  source 1..203: mol_type = other DNA

SEQ ID NO: 30928 - DNA, 203 bp, Homo sapiens; identical to SEQ ID NO: 6981
  source 1..203: mol_type = other DNA

SEQ ID NO: 30929 - DNA, 203 bp, Homo sapiens; identical to SEQ ID NO: 6982
  source 1..203: mol_type = other DNA

SEQ ID NO: 30930 - DNA, 203 bp, Homo sapiens; identical to SEQ ID NO: 6983
  source 1..203: mol_type = other DNA

SEQ ID NO: 30931 - DNA, 203 bp, Homo sapiens; identical to SEQ ID NO: 6984
  source 1..203: mol_type = other DNA

SEQ ID NO: 30932 - DNA, 203 bp, Homo sapiens; identical to SEQ ID NO: 6985
  source 1..203: mol_type = other DNA

SEQ ID NO: 30933 - DNA, 203 bp, Homo sapiens; identical to SEQ ID NO: 6986
  source 1..203: mol_type = other DNA

SEQ ID NO: 30934 - DNA, 203 bp, Homo sapiens; identical to SEQ ID NO: 6987
  source 1..203: mol_type = other DNA

SEQ ID NO: 30935 - DNA, 203 bp, Homo sapiens; identical to SEQ ID NO: 6999
  source 1..203: mol_type = other DNA

SEQ ID NO: 30936 - DNA, 203 bp, Homo sapiens; identical to SEQ ID NO: 7000
  source 1..203: mol_type = other DNA

SEQ ID NO: 30937 - DNA, 203 bp, Homo sapiens; identical to SEQ ID NO: 7001
  source 1..203: mol_type = other DNA

SEQ ID NO: 30938 - DNA, 203 bp, Homo sapiens; identical to SEQ ID NO: 7002
  source 1..203: mol_type = other DNA

SEQ ID NO: 30939 - DNA, 203 bp, Homo sapiens; identical to SEQ ID NO: 7003
  source 1..203: mol_type = other DNA

SEQ ID NO: 30940 - DNA, 203 bp, Homo sapiens; identical to SEQ ID NO: 7004
  source 1..203: mol_type = other DNA

SEQ ID NO: 30941 - DNA, 203 bp, Homo sapiens; identical to SEQ ID NO: 7005
  source 1..203: mol_type = other DNA

SEQ ID NO: 30942 - DNA, 203 bp, Homo sapiens; identical to SEQ ID NO: 7006
  source 1..203: mol_type = other DNA

SEQ ID NO: 30943 - DNA, 203 bp, Homo sapiens; identical to SEQ ID NO: 7007
  source 1..203: mol_type = other DNA

SEQ ID NO: 30944 - DNA, 203 bp, Homo sapiens; identical to SEQ ID NO: 7008
  source 1..203: mol_type = other DNA

SEQ ID NO: 30945 - DNA, 203 bp, Homo sapiens; identical to SEQ ID NO: 7012
  source 1..203: mol_type = other DNA

SEQ ID NO: 30946 - DNA, 203 bp, Homo sapiens; identical to SEQ ID NO: 7056
  source 1..203: mol_type = other DNA

SEQ ID NO: 30947 - DNA, 203 bp, Homo sapiens; identical to SEQ ID NO: 7074
  source 1..203: mol_type = other DNA

SEQ ID NO: 30948 - DNA, 203 bp, Homo sapiens; identical to SEQ ID NO: 7075
  source 1..203: mol_type = other DNA

SEQ ID NO: 30949 - DNA, 203 bp, Homo sapiens; identical to SEQ ID NO: 7076
  source 1..203: mol_type = other DNA

SEQ ID NO: 30950 - DNA, 203 bp, Homo sapiens; identical to SEQ ID NO: 7077
  source 1..203: mol_type = other DNA

SEQ ID NO: 30951 - DNA, 203 bp, Homo sapiens; identical to SEQ ID NO: 7078
  source 1..203: mol_type = other DNA

SEQ ID NO: 30952 - DNA, 203 bp, Homo sapiens; identical to SEQ ID NO: 7079
  source 1..203: mol_type = other DNA

SEQ ID NO: 30953 - DNA, 203 bp, Homo sapiens; identical to SEQ ID NO: 7080
  source 1..203: mol_type = other DNA

SEQ ID NO: 30954 - DNA, 203 bp, Homo sapiens; identical to SEQ ID NO: 7081
  source 1..203: mol_type = other DNA

SEQ ID NO: 30955 - DNA, 203 bp, Homo sapiens; identical to SEQ ID NO: 7082
  source 1..203: mol_type = other DNA

SEQ ID NO: 30956 - DNA, 203 bp, Homo sapiens; identical to SEQ ID NO: 7083
  source 1..203: mol_type = other DNA

SEQ ID NO: 30957 - DNA, 203 bp, Homo sapiens; identical to SEQ ID NO: 7084
  source 1..203: mol_type = other DNA

SEQ ID NO: 30958 - DNA, 203 bp, Homo sapiens; identical to SEQ ID NO: 7085
  source 1..203: mol_type = other DNA

SEQ ID NO: 30959 - DNA, 203 bp, Homo sapiens; identical to SEQ ID NO: 7086
  source 1..203: mol_type = other DNA

SEQ ID NO: 30960 - DNA, 203 bp, Homo sapiens; identical to SEQ ID NO: 7087
  source 1..203: mol_type = other DNA

SEQ ID NO: 30961 - DNA, 203 bp, Homo sapiens; identical to SEQ ID NO: 7088
  source 1..203: mol_type = other DNA

SEQ ID NO: 30962 - DNA, 203 bp, Homo sapiens; identical to SEQ ID NO: 7089
  source 1..203: mol_type = other DNA

SEQ ID NO: 30963 - DNA, 203 bp, Homo sapiens; identical to SEQ ID NO: 7090
  source 1..203: mol_type = other DNA

SEQ ID NO: 30964 - DNA, 203 bp, Homo sapiens; identical to SEQ ID NO: 7091
  source 1..203: mol_type = other DNA

SEQ ID NO: 30965 - DNA, 203 bp, Homo sapiens; identical to SEQ ID NO: 7092
  source 1..203: mol_type = other DNA

SEQ ID NO: 30966 - DNA, 203 bp, Homo sapiens; identical to SEQ ID NO: 7093
  source 1..203: mol_type = other DNA

SEQ ID NO: 30967 - DNA, 203 bp, Homo sapiens; identical to SEQ ID NO: 7094
  source 1..203: mol_type = other DNA

SEQ ID NO: 30968 - DNA, 203 bp, Homo sapiens; identical to SEQ ID NO: 7095
  source 1..203: mol_type = other DNA

SEQ ID NO: 30969 - DNA, 203 bp, Homo sapiens; identical to SEQ ID NO: 7096
  source 1..203: mol_type = other DNA

SEQ ID NO: 30970 - DNA, 203 bp, Homo sapiens; identical to SEQ ID NO: 7097
  source 1..203: mol_type = other DNA

SEQ ID NO: 30971 - DNA, 203 bp, Homo sapiens; identical to SEQ ID NO: 7098
  source 1..203: mol_type = other DNA

SEQ ID NO: 30972 - DNA, 203 bp, Homo sapiens; identical to SEQ ID NO: 7099
  source 1..203: mol_type = other DNA

SEQ ID NO: 30973 - DNA, 203 bp, Homo sapiens; identical to SEQ ID NO: 7100
  source 1..203: mol_type = other DNA

SEQ ID NO: 30974 - DNA, 203 bp, Homo sapiens; identical to SEQ ID NO: 7101
  source 1..203: mol_type = other DNA

SEQ ID NO: 30975 - DNA, 203 bp, Homo sapiens; identical to SEQ ID NO: 7118
  source 1..203: mol_type = other DNA

SEQ ID NO: 30976 - DNA, 203 bp, Homo sapiens; identical to SEQ ID NO: 7119
  source 1..203: mol_type = other DNA

SEQ ID NO: 30977 - DNA, 203 bp, Homo sapiens; identical to SEQ ID NO: 7120
  source 1..203: mol_type = other DNA

SEQ ID NO: 30978 - DNA, 203 bp, Homo sapiens; identical to SEQ ID NO: 7121
  source 1..203: mol_type = other DNA

SEQ ID NO: 30979 - DNA, 203 bp, Homo sapiens; identical to SEQ ID NO: 7123
  source 1..203: mol_type = other DNA

SEQ ID NO: 30980 - DNA, 203 bp, Homo sapiens; identical to SEQ ID NO: 7124
  source 1..203: mol_type = other DNA

SEQ ID NO: 30981 - DNA, 203 bp, Homo sapiens; identical to SEQ ID NO: 7125
  source 1..203: mol_type = other DNA

SEQ ID NO: 30982 - DNA, 203 bp, Homo sapiens; identical to SEQ ID NO: 7126
  source 1..203: mol_type = other DNA

SEQ ID NO: 30983 - DNA, 203 bp, Homo sapiens; identical to SEQ ID NO: 7127
  source 1..203: mol_type = other DNA

SEQ ID NO: 30984 - DNA, 203 bp, Homo sapiens; identical to SEQ ID NO: 7149
  source 1..203: mol_type = other DNA

SEQ ID NO: 30985 - DNA, 203 bp, Homo sapiens; identical to SEQ ID NO: 7150
  source 1..203: mol_type = other DNA

SEQ ID NO: 30986 - DNA, 203 bp, Homo sapiens; identical to SEQ ID NO: 7151
  source 1..203: mol_type = other DNA

SEQ ID NO: 30987 - DNA, 203 bp, Homo sapiens; identical to SEQ ID NO: 7152
  source 1..203: mol_type = other DNA

SEQ ID NO: 30988 - DNA, 203 bp, Homo sapiens; identical to SEQ ID NO: 7153
  source 1..203: mol_type = other DNA

SEQ ID NO: 30989 - DNA, 203 bp, Homo sapiens; identical to SEQ ID NO: 7154
  source 1..203: mol_type = other DNA

SEQ ID NO: 30990 - DNA, 203 bp, Homo sapiens; identical to SEQ ID NO: 7156
  source 1..203: mol_type = other DNA

SEQ ID NO: 30991 - DNA, 203 bp, Homo sapiens; identical to SEQ ID NO: 7157
  source 1..203: mol_type = other DNA

SEQ ID NO: 30992 - DNA, 203 bp, Homo sapiens; identical to SEQ ID NO: 7158
  source 1..203: mol_type = other DNA

SEQ ID NO: 30993 - DNA, 203 bp, Homo sapiens; identical to SEQ ID NO: 7159
  source 1..203: mol_type = other DNA

SEQ ID NO: 30994 - DNA, 203 bp, Homo sapiens; identical to SEQ ID NO: 7160
  source 1..203: mol_type = other DNA

SEQ ID NO: 30995 - DNA, 203 bp, Homo sapiens; identical to SEQ ID NO: 7161
  source 1..203: mol_type = other DNA

SEQ ID NO: 30996 - DNA, 203 bp, Homo sapiens; identical to SEQ ID NO: 7163
  source 1..203: mol_type = other DNA

SEQ ID NO: 30997 - DNA, 203 bp, Homo sapiens; identical to SEQ ID NO: 7164
  source 1..203: mol_type = other DNA

SEQ ID NO: 30998 - DNA, 203 bp, Homo sapiens; identical to SEQ ID NO: 7165
  source 1..203: mol_type = other DNA

SEQ ID NO: 30999 - DNA, 203 bp, Homo sapiens; identical to SEQ ID NO: 7166
  source 1..203: mol_type = other DNA

SEQ ID NO: 31000 - DNA, 203 bp, Homo sapiens; identical to SEQ ID NO: 7167
  source 1..203: mol_type = other DNA

SEQ ID NO: 31001 - DNA, 203 bp, Homo sapiens; identical to SEQ ID NO: 7168
  source 1..203: mol_type = other DNA

SEQ ID NO: 31002 - DNA, 203 bp, Homo sapiens; identical to SEQ ID NO: 7169
  source 1..203: mol_type = other DNA

SEQ ID NO: 31003 - DNA, 203 bp, Homo sapiens; identical to SEQ ID NO: 7170
  source 1..203: mol_type = other DNA

SEQ ID NO: 31004 - DNA, 203 bp, Homo sapiens; identical to SEQ ID NO: 7171
  source 1..203: mol_type = other DNA

SEQ ID NO: 31005 - DNA, 203 bp, Homo sapiens; identical to SEQ ID NO: 7172
  source 1..203: mol_type = other DNA

SEQ ID NO: 31006 - DNA, 203 bp, Homo sapiens; identical to SEQ ID NO: 7173
  source 1..203: mol_type = other DNA

SEQ ID NO: 31007 - DNA, 203 bp, Homo sapiens; identical to SEQ ID NO: 7174
  source 1..203: mol_type = other DNA

SEQ ID NO: 31008 - DNA, 203 bp, Homo sapiens; identical to SEQ ID NO: 7175
  source 1..203: mol_type = other DNA

SEQ ID NO: 31009 - DNA, 203 bp, Homo sapiens; identical to SEQ ID NO: 7176
  source 1..203: mol_type = other DNA

SEQ ID NO: 31010 - DNA, 203 bp, Homo sapiens; identical to SEQ ID NO: 7177
  source 1..203: mol_type = other DNA

SEQ ID NO: 31011 - DNA, 203 bp, Homo sapiens; identical to SEQ ID NO: 7178
  source 1..203: mol_type = other DNA

SEQ ID NO: 31012 - DNA, 203 bp, Homo sapiens; identical to SEQ ID NO: 7179
  source 1..203: mol_type = other DNA

SEQ ID NO: 31013 - DNA, 203 bp, Homo sapiens; identical to SEQ ID NO: 7180
  source 1..203: mol_type = other DNA

SEQ ID NO: 31014 - DNA, 203 bp, Homo sapiens; identical to SEQ ID NO: 7181
  source 1..203: mol_type = other DNA

SEQ ID NO: 31015 - DNA, 203 bp, Homo sapiens; identical to SEQ ID NO: 7182
  source 1..203: mol_type = other DNA

SEQ ID NO: 31016 - DNA, 203 bp, Homo sapiens; identical to SEQ ID NO: 7183
  source 1..203: mol_type = other DNA

SEQ ID NO: 31017 - DNA, 203 bp, Homo sapiens; identical to SEQ ID NO: 7184
  source 1..203: mol_type = other DNA

SEQ ID NO: 31018 - DNA, 203 bp, Homo sapiens; identical to SEQ ID NO: 7185
  source 1..203: mol_type = other DNA

SEQ ID NO: 31019 - DNA, 203 bp, Homo sapiens; identical to SEQ ID NO: 7186
  source 1..203: mol_type = other DNA

SEQ ID NO: 31020 - DNA, 203 bp, Homo sapiens; identical to SEQ ID NO: 7187
  source 1..203: mol_type = other DNA

SEQ ID NO: 31021 - DNA, 203 bp, Homo sapiens; identical to SEQ ID NO: 7188
  source 1..203: mol_type = other DNA

SEQ ID NO: 31022 - DNA, 203 bp, Homo sapiens; identical to SEQ ID NO: 7189
  source 1..203: mol_type = other DNA

SEQ ID NO: 31023 - DNA, 203 bp, Homo sapiens; identical to SEQ ID NO: 7190
  source 1..203: mol_type = other DNA

SEQ ID NO: 31024 - DNA, 203 bp, Homo sapiens; identical to SEQ ID NO: 7192
  source 1..203: mol_type = other DNA

SEQ ID NO: 31025 - DNA, 203 bp, Homo sapiens; identical to SEQ ID NO: 7199
  source 1..203: mol_type = other DNA

SEQ ID NO: 31026 - DNA, 203 bp, Homo sapiens; identical to SEQ ID NO: 7208
  source 1..203: mol_type = other DNA

SEQ ID NO: 31027 - DNA, 203 bp, Homo sapiens; identical to SEQ ID NO: 7213
  source 1..203: mol_type = other DNA

SEQ ID NO: 31028 - DNA, 203 bp, Homo sapiens; identical to SEQ ID NO: 7214
  source 1..203: mol_type = other DNA

SEQ ID NO: 31029 - DNA, 203 bp, Homo sapiens; identical to SEQ ID NO: 7215
  source 1..203: mol_type = other DNA

SEQ ID NO: 31030 - DNA, 203 bp, Homo sapiens; identical to SEQ ID NO: 7216
  source 1..203: mol_type = other DNA

SEQ ID NO: 31031 - DNA, 203 bp, Homo sapiens; identical to SEQ ID NO: 7217
  source 1..203: mol_type = other DNA

SEQ ID NO: 31032 - DNA, 203 bp, Homo sapiens; identical to SEQ ID NO: 7219
  source 1..203: mol_type = other DNA

SEQ ID NO: 31033 - DNA, 203 bp, Homo sapiens; identical to SEQ ID NO: 7220
  source 1..203: mol_type = other DNA

SEQ ID NO: 31034 - DNA, 203 bp, Homo sapiens; identical to SEQ ID NO: 7221
  source 1..203: mol_type = other DNA

SEQ ID NO: 31035 - DNA, 203 bp, Homo sapiens; identical to SEQ ID NO: 7222
  source 1..203: mol_type = other DNA

SEQ ID NO: 31036 - DNA, 203 bp, Homo sapiens; identical to SEQ ID NO: 7223
  source 1..203: mol_type = other DNA

SEQ ID NO: 31037 - DNA, 203 bp, Homo sapiens; identical to SEQ ID NO: 7224
  source 1..203: mol_type = other DNA

SEQ ID NO: 31038 - DNA, 203 bp, Homo sapiens; identical to SEQ ID NO: 7225
  source 1..203: mol_type = other DNA

SEQ ID NO: 31039 - DNA, 203 bp, Homo sapiens; identical to SEQ ID NO: 7226
  source 1..203: mol_type = other DNA

SEQ ID NO: 31040 - DNA, 203 bp, Homo sapiens; identical to SEQ ID NO: 7229
  source 1..203: mol_type = other DNA

SEQ ID NO: 31041 - DNA, 203 bp, Homo sapiens; identical to SEQ ID NO: 7230
  source 1..203: mol_type = other DNA

SEQ ID NO: 31042 - DNA, 203 bp, Homo sapiens; identical to SEQ ID NO: 7238
  source 1..203: mol_type = other DNA

SEQ ID NO: 31043 - DNA, 203 bp, Homo sapiens; identical to SEQ ID NO: 7239
  source 1..203: mol_type = other DNA

SEQ ID NO: 31044 - DNA, 203 bp, Homo sapiens; identical to SEQ ID NO: 7240
  source 1..203: mol_type = other DNA

SEQ ID NO: 31045 - DNA, 203 bp, Homo sapiens; identical to SEQ ID NO: 7241
  source 1..203: mol_type = other DNA

SEQ ID NO: 31046 - DNA, 203 bp, Homo sapiens; identical to SEQ ID NO: 7242
  source 1..203: mol_type = other DNA

SEQ ID NO: 31047 - DNA, 203 bp, Homo sapiens; identical to SEQ ID NO: 7243
  source 1..203: mol_type = other DNA

SEQ ID NO: 31048 - DNA, 203 bp, Homo sapiens; identical to SEQ ID NO: 7244
  source 1..203: mol_type = other DNA

SEQ ID NO: 31049 - DNA, 203 bp, Homo sapiens; identical to SEQ ID NO: 7245
  source 1..203: mol_type = other DNA

SEQ ID NO: 31050 - DNA, 203 bp, Homo sapiens; identical to SEQ ID NO: 7250
  source 1..203: mol_type = other DNA

SEQ ID NO: 31051 - DNA, 203 bp, Homo sapiens; identical to SEQ ID NO: 7251
  source 1..203: mol_type = other DNA

SEQ ID NO: 31052 - DNA, 203 bp, Homo sapiens; identical to SEQ ID NO: 7252
  source 1..203: mol_type = other DNA

SEQ ID NO: 31053 - DNA, 203 bp, Homo sapiens; identical to SEQ ID NO: 7253
  source 1..203: mol_type = other DNA

SEQ ID NO: 31054 - DNA, 203 bp, Homo sapiens; identical to SEQ ID NO: 7254
  source 1..203: mol_type = other DNA

SEQ ID NO: 31055 - DNA, 203 bp, Homo sapiens; identical to SEQ ID NO: 7255
  source 1..203: mol_type = other DNA

SEQ ID NO: 31056 - DNA, 203 bp, Homo sapiens; identical to SEQ ID NO: 7256
  source 1..203: mol_type = other DNA

SEQ ID NO: 31057 - DNA, 203 bp, Homo sapiens; identical to SEQ ID NO: 7257
  source 1..203: mol_type = other DNA

SEQ ID NO: 31058 - DNA, 203 bp, Homo sapiens; identical to SEQ ID NO: 7258
  source 1..203: mol_type = other DNA

SEQ ID NO: 31059 - DNA, 203 bp, Homo sapiens; identical to SEQ ID NO: 7259
  source 1..203: mol_type = other DNA

SEQ ID NO: 31060 - DNA, 203 bp, Homo sapiens; identical to SEQ ID NO: 7263
  source 1..203: mol_type = other DNA

SEQ ID NO: 31061 - DNA, 203 bp, Homo sapiens; identical to SEQ ID NO: 7279
  source 1..203: mol_type = other DNA

SEQ ID NO: 31062 - DNA, 203 bp, Homo sapiens; identical to SEQ ID NO: 7281
  source 1..203: mol_type = other DNA

SEQ ID NO: 31063 - DNA, 203 bp, Homo sapiens; identical to SEQ ID NO: 7329
  source 1..203: mol_type = other DNA

SEQ ID NO: 31064 - DNA, 203 bp, Homo sapiens; identical to SEQ ID NO: 7333
  source 1..203: mol_type = other DNA

SEQ ID NO: 31065 - DNA, 203 bp, Homo sapiens; identical to SEQ ID NO: 7336
  source 1..203: mol_type = other DNA

SEQ ID NO: 31066 - DNA, 203 bp, Homo sapiens; identical to SEQ ID NO: 7361
  source 1..203: mol_type = other DNA

SEQ ID NO: 31067 - DNA, 203 bp, Homo sapiens; identical to SEQ ID NO: 7362
  source 1..203: mol_type = other DNA

SEQ ID NO: 31068 - DNA, 203 bp, Homo sapiens; identical to SEQ ID NO: 7369
  source 1..203: mol_type = other DNA

SEQ ID NO: 31069 - DNA, 203 bp, Homo sapiens; identical to SEQ ID NO: 7371
  source 1..203: mol_type = other DNA

SEQ ID NO: 31070 - DNA, 203 bp, Homo sapiens; identical to SEQ ID NO: 7395
  source 1..203: mol_type = other DNA

SEQ ID NO: 31071 - DNA, 203 bp, Homo sapiens; identical to SEQ ID NO: 7432
  source 1..203: mol_type = other DNA

SEQ ID NO: 31072 - DNA, 203 bp, Homo sapiens; identical to SEQ ID NO: 7475
  source 1..203: mol_type = other DNA

SEQ ID NO: 31073 - DNA, 203 bp, Homo sapiens; identical to SEQ ID NO: 7510
  source 1..203: mol_type = other DNA

SEQ ID NO: 31074 - DNA, 203 bp, Homo sapiens; identical to SEQ ID NO: 7511
  source 1..203: mol_type = other DNA

SEQ ID NO: 31075 - DNA, 203 bp, Homo sapiens; identical to SEQ ID NO: 7512
  source 1..203: mol_type = other DNA

SEQ ID NO: 31076 - DNA, 203 bp, Homo sapiens; identical to SEQ ID NO: 7515
  source 1..203: mol_type = other DNA

SEQ ID NO: 31077 - DNA, 203 bp, Homo sapiens; identical to SEQ ID NO: 7529
  source 1..203: mol_type = other DNA

SEQ ID NO: 31078 - DNA, 203 bp, Homo sapiens; identical to SEQ ID NO: 7552
  source 1..203: mol_type = other DNA

SEQ ID NO: 31079 - DNA, 203 bp, Homo sapiens; identical to SEQ ID NO: 7555
  source 1..203: mol_type = other DNA

SEQ ID NO: 31080 - DNA, 203 bp, Homo sapiens; identical to SEQ ID NO: 7556
  source 1..203: mol_type = other DNA

SEQ ID NO: 31081 - DNA, 203 bp, Homo sapiens; identical to SEQ ID NO: 7567
  source 1..203: mol_type = other DNA

SEQ ID NO: 31082 - DNA, 203 bp, Homo sapiens; identical to SEQ ID NO: 7576
  source 1..203: mol_type = other DNA

SEQ ID NO: 31083 - DNA, 203 bp, Homo sapiens; identical to SEQ ID NO: 7578
  source 1..203: mol_type = other DNA

SEQ ID NO: 31084 - DNA, 203 bp, Homo sapiens; identical to SEQ ID NO: 7579
  source 1..203: mol_type = other DNA

SEQ ID NO: 31085 - DNA, 203 bp, Homo sapiens; identical to SEQ ID NO: 7580
  source 1..203: mol_type = other DNA

SEQ ID NO: 31086 - DNA, 203 bp, Homo sapiens; identical to SEQ ID NO: 7581
  source 1..203: mol_type = other DNA

SEQ ID NO: 31087 - DNA, 203 bp, Homo sapiens; identical to SEQ ID NO: 7582
  source 1..203: mol_type = other DNA

SEQ ID NO: 31088 - DNA, 203 bp, Homo sapiens; identical to SEQ ID NO: 7583
  source 1..203: mol_type = other DNA

SEQ ID NO: 31089 - DNA, 203 bp, Homo sapiens; identical to SEQ ID NO: 7584
  source 1..203: mol_type = other DNA

SEQ ID NO: 31090 - DNA, 203 bp, Homo sapiens; identical to SEQ ID NO: 7585
  source 1..203: mol_type = other DNA

SEQ ID NO: 31091 - DNA, 203 bp, Homo sapiens; identical to SEQ ID NO: 7586
  source 1..203: mol_type = other DNA

SEQ ID NO: 31092 - DNA, 203 bp, Homo sapiens; identical to SEQ ID NO: 7587
  source 1..203: mol_type = other DNA

SEQ ID NO: 31093 - DNA, 203 bp, Homo sapiens; identical to SEQ ID NO: 7588
  source 1..203: mol_type = other DNA

SEQ ID NO: 31094 - DNA, 203 bp, Homo sapiens; identical to SEQ ID NO: 7589
  source 1..203: mol_type = other DNA

SEQ ID NO: 31095 - DNA, 203 bp, Homo sapiens; identical to SEQ ID NO: 7590
  source 1..203: mol_type = other DNA

SEQ ID NO: 31096 - DNA, 203 bp, Homo sapiens; identical to SEQ ID NO: 7591
  source 1..203: mol_type = other DNA

SEQ ID NO: 31097 - DNA, 203 bp, Homo sapiens; identical to SEQ ID NO: 7592
  source 1..203: mol_type = other DNA

SEQ ID NO: 31098 - DNA, 203 bp, Homo sapiens; identical to SEQ ID NO: 7593
  source 1..203: mol_type = other DNA

SEQ ID NO: 31099 - DNA, 203 bp, Homo sapiens; identical to SEQ ID NO: 7594
  source 1..203: mol_type = other DNA

SEQ ID NO: 31100 - DNA, 203 bp, Homo sapiens; identical to SEQ ID NO: 7595
  source 1..203: mol_type = other DNA

SEQ ID NO: 31101 - DNA, 203 bp, Homo sapiens; identical to SEQ ID NO: 7596
  source 1..203: mol_type = other DNA

SEQ ID NO: 31102 - DNA, 203 bp, Homo sapiens; identical to SEQ ID NO: 7597
  source 1..203: mol_type = other DNA

SEQ ID NO: 31103 - DNA, 203 bp, Homo sapiens; identical to SEQ ID NO: 7598
  source 1..203: mol_type = other DNA

SEQ ID NO: 31104 - DNA, 203 bp, Homo sapiens; identical to SEQ ID NO: 7599
  source 1..203: mol_type = other DNA

SEQ ID NO: 31105 - DNA, 203 bp, Homo sapiens; identical to SEQ ID NO: 7600
  source 1..203: mol_type = other DNA

SEQ ID NO: 31106 - DNA, 203 bp, Homo sapiens; identical to SEQ ID NO: 7601
  source 1..203: mol_type = other DNA

SEQ ID NO: 31107 - DNA, 203 bp, Homo sapiens; identical to SEQ ID NO: 7602
  source 1..203: mol_type = other DNA

SEQ ID NO: 31108 - DNA, 203 bp, Homo sapiens; identical to SEQ ID NO: 7603
  source 1..203: mol_type = other DNA

SEQ ID NO: 31109 - DNA, 203 bp, Homo sapiens; identical to SEQ ID NO: 7605
  source 1..203: mol_type = other DNA

SEQ ID NO: 31110 - DNA, 203 bp, Homo sapiens; identical to SEQ ID NO: 7606
  source 1..203: mol_type = other DNA

SEQ ID NO: 31111 - DNA, 203 bp, Homo sapiens; identical to SEQ ID NO: 7607
  source 1..203: mol_type = other DNA

SEQ ID NO: 31112 - DNA, 203 bp, Homo sapiens; identical to SEQ ID NO: 7608
  source 1..203: mol_type = other DNA

SEQ ID NO: 31113 - DNA, 203 bp, Homo sapiens; identical to SEQ ID NO: 7609
  source 1..203: mol_type = other DNA

SEQ ID NO: 31114 - DNA, 203 bp, Homo sapiens; identical to SEQ ID NO: 7610
  source 1..203: mol_type = other DNA

SEQ ID NO: 31115 - DNA, 203 bp, Homo sapiens; identical to SEQ ID NO: 7611
  source 1..203: mol_type = other DNA

SEQ ID NO: 31116 - DNA, 203 bp, Homo sapiens; identical to SEQ ID NO: 7612
  source 1..203: mol_type = other DNA

SEQ ID NO: 31117 - DNA, 203 bp, Homo sapiens; identical to SEQ ID NO: 7613
  source 1..203: mol_type = other DNA

SEQ ID NO: 31118 - DNA, 203 bp, Homo sapiens; identical to SEQ ID NO: 7614
  source 1..203: mol_type = other DNA

SEQ ID NO: 31119 - DNA, 203 bp, Homo sapiens; identical to SEQ ID NO: 7615
  source 1..203: mol_type = other DNA

SEQ ID NO: 31120 - DNA, 203 bp, Homo sapiens; identical to SEQ ID NO: 7616
  source 1..203: mol_type = other DNA

SEQ ID NO: 31121 - DNA, 203 bp, Homo sapiens; identical to SEQ ID NO: 7617
  source 1..203: mol_type = other DNA

SEQ ID NO: 31122 - DNA, 203 bp, Homo sapiens; identical to SEQ ID NO: 7618
  source 1..203: mol_type = other DNA

SEQ ID NO: 31123 - DNA, 203 bp, Homo sapiens; identical to SEQ ID NO: 7619
  source 1..203: mol_type = other DNA

SEQ ID NO: 31124 - DNA, 203 bp, Homo sapiens; identical to SEQ ID NO: 7620
  source 1..203: mol_type = other DNA

SEQ ID NO: 31125 - DNA, 203 bp, Homo sapiens; identical to SEQ ID NO: 7621
  source 1..203: mol_type = other DNA

SEQ ID NO: 31126 - DNA, 203 bp, Homo sapiens; identical to SEQ ID NO: 7622
  source 1..203: mol_type = other DNA

SEQ ID NO: 31127 - DNA, 203 bp, Homo sapiens; identical to SEQ ID NO: 7623
  source 1..203: mol_type = other DNA

SEQ ID NO: 31128 - DNA, 203 bp, Homo sapiens; identical to SEQ ID NO: 7625
  source 1..203: mol_type = other DNA

SEQ ID NO: 31129 - DNA, 203 bp, Homo sapiens; identical to SEQ ID NO: 7626
  source 1..203: mol_type = other DNA

SEQ ID NO: 31130 - DNA, 203 bp, Homo sapiens; identical to SEQ ID NO: 7627
  source 1..203: mol_type = other DNA

SEQ ID NO: 31131 - DNA, 203 bp, Homo sapiens; identical to SEQ ID NO: 7628
  source 1..203: mol_type = other DNA

SEQ ID NO: 31132 - DNA, 203 bp, Homo sapiens; identical to SEQ ID NO: 7629
  source 1..203: mol_type = other DNA

SEQ ID NO: 31133 - DNA, 203 bp, Homo sapiens; identical to SEQ ID NO: 7630
  source 1..203: mol_type = other DNA

SEQ ID NO: 31134 - DNA, 203 bp, Homo sapiens; identical to SEQ ID NO: 7631
  source 1..203: mol_type = other DNA

SEQ ID NO: 31135 - DNA, 203 bp, Homo sapiens; identical to SEQ ID NO: 7632
  source 1..203: mol_type = other DNA

SEQ ID NO: 31136 - DNA, 203 bp, Homo sapiens; identical to SEQ ID NO: 7633
  source 1..203: mol_type = other DNA

SEQ ID NO: 31137 - DNA, 203 bp, Homo sapiens; identical to SEQ ID NO: 7634
  source 1..203: mol_type = other DNA

SEQ ID NO: 31138 - DNA, 203 bp, Homo sapiens; identical to SEQ ID NO: 7635
  source 1..203: mol_type = other DNA

SEQ ID NO: 31139 - DNA, 203 bp, Homo sapiens; identical to SEQ ID NO: 7636
  source 1..203: mol_type = other DNA

SEQ ID NO: 31140 - DNA, 203 bp, Homo sapiens; identical to SEQ ID NO: 7637
  source 1..203: mol_type = other DNA

SEQ ID NO: 31141 - DNA, 203 bp, Homo sapiens; identical to SEQ ID NO: 7638
  source 1..203: mol_type = other DNA

SEQ ID NO: 31142 - DNA, 203 bp, Homo sapiens; identical to SEQ ID NO: 7639
  source 1..203: mol_type = other DNA

SEQ ID NO: 31143 - DNA, 203 bp, Homo sapiens; identical to SEQ ID NO: 7640
  source 1..203: mol_type = other DNA

SEQ ID NO: 31144 - DNA, 203 bp, Homo sapiens; identical to SEQ ID NO: 7641
  source 1..203: mol_type = other DNA

SEQ ID NO: 31145 - DNA, 203 bp, Homo sapiens; identical to SEQ ID NO: 7642
  source 1..203: mol_type = other DNA

SEQ ID NO: 31146 - DNA, 203 bp, Homo sapiens; identical to SEQ ID NO: 7643
  source 1..203: mol_type = other DNA

SEQ ID NO: 31147 - DNA, 203 bp, Homo sapiens; identical to SEQ ID NO: 7644
  source 1..203: mol_type = other DNA

SEQ ID NO: 31148 - DNA, 203 bp, Homo sapiens; identical to SEQ ID NO: 7648
  source 1..203: mol_type = other DNA

SEQ ID NO: 31149 - DNA, 203 bp, Homo sapiens; identical to SEQ ID NO: 7649
  source 1..203: mol_type = other DNA

SEQ ID NO: 31150 - DNA, 203 bp, Homo sapiens; identical to SEQ ID NO: 7650
  source 1..203: mol_type = other DNA

SEQ ID NO: 31151 - DNA, 203 bp, Homo sapiens; identical to SEQ ID NO: 7651
  source 1..203: mol_type = other DNA

SEQ ID NO: 31152 - DNA, 203 bp, Homo sapiens; identical to SEQ ID NO: 7652
  source 1..203: mol_type = other DNA

SEQ ID NO: 31153 - DNA, 203 bp, Homo sapiens; identical to SEQ ID NO: 7653
  source 1..203: mol_type = other DNA

SEQ ID NO: 31154 - DNA, 203 bp, Homo sapiens; identical to SEQ ID NO: 7654
  source 1..203: mol_type = other DNA

SEQ ID NO: 31155 - DNA, 203 bp, Homo sapiens; identical to SEQ ID NO: 7655
  source 1..203: mol_type = other DNA

SEQ ID NO: 31156 - DNA, 203 bp, Homo sapiens; identical to SEQ ID NO: 7656
  source 1..203: mol_type = other DNA

SEQ ID NO: 31157 - DNA, 203 bp, Homo sapiens; identical to SEQ ID NO: 7657
  source 1..203: mol_type = other DNA

SEQ ID NO: 31158 - DNA, 203 bp, Homo sapiens; identical to SEQ ID NO: 7658
  source 1..203: mol_type = other DNA

SEQ ID NO: 31159 - DNA, 203 bp, Homo sapiens; identical to SEQ ID NO: 7659
  source 1..203: mol_type = other DNA

SEQ ID NO: 31160 - DNA, 203 bp, Homo sapiens; identical to SEQ ID NO: 7660
  source 1..203: mol_type = other DNA

SEQ ID NO: 31161 - DNA, 203 bp, Homo sapiens; identical to SEQ ID NO: 7661
  source 1..203: mol_type = other DNA

SEQ ID NO: 31162 - DNA, 203 bp, Homo sapiens; identical to SEQ ID NO: 7662
  source 1..203: mol_type = other DNA

SEQ ID NO: 31163 - DNA, 203 bp, Homo sapiens; identical to SEQ ID NO: 7663
  source 1..203: mol_type = other DNA

SEQ ID NO: 31164 - DNA, 203 bp, Homo sapiens; identical to SEQ ID NO: 7664
  source 1..203: mol_type = other DNA

SEQ ID NO: 31165 - DNA, 203 bp, Homo sapiens; identical to SEQ ID NO: 7665
  source 1..203: mol_type = other DNA

SEQ ID NO: 31166 - DNA, 203 bp, Homo sapiens; identical to SEQ ID NO: 7666
  source 1..203: mol_type = other DNA

SEQ ID NO: 31167 - DNA, 203 bp, Homo sapiens; identical to SEQ ID NO: 7667
  source 1..203: mol_type = other DNA

SEQ ID NO: 31168 - DNA, 203 bp, Homo sapiens; identical to SEQ ID NO: 7668
  source 1..203: mol_type = other DNA

SEQ ID NO: 31169 - DNA, 203 bp, Homo sapiens; identical to SEQ ID NO: 7669
  source 1..203: mol_type = other DNA

SEQ ID NO: 31170 - DNA, 203 bp, Homo sapiens; identical to SEQ ID NO: 7670
  source 1..203: mol_type = other DNA

SEQ ID NO: 31171 - DNA, 203 bp, Homo sapiens; identical to SEQ ID NO: 7671
  source 1..203: mol_type = other DNA

SEQ ID NO: 31172 - DNA, 203 bp, Homo sapiens; identical to SEQ ID NO: 7673
  source 1..203: mol_type = other DNA

SEQ ID NO: 31173 - DNA, 203 bp, Homo sapiens; identical to SEQ ID NO: 7674
  source 1..203: mol_type = other DNA

SEQ ID NO: 31174 - DNA, 203 bp, Homo sapiens; identical to SEQ ID NO: 7675
  source 1..203: mol_type = other DNA

SEQ ID NO: 31175 - DNA, 203 bp, Homo sapiens; identical to SEQ ID NO: 7676
  source 1..203: mol_type = other DNA

SEQ ID NO: 31176 - DNA, 203 bp, Homo sapiens; identical to SEQ ID NO: 7677
  source 1..203: mol_type = other DNA

SEQ ID NO: 31177 - DNA, 203 bp, Homo sapiens; identical to SEQ ID NO: 7678
  source 1..203: mol_type = other DNA

SEQ ID NO: 31178 - DNA, 203 bp, Homo sapiens; identical to SEQ ID NO: 7679
  source 1..203: mol_type = other DNA

SEQ ID NO: 31179 - DNA, 203 bp, Homo sapiens; identical to SEQ ID NO: 7680
  source 1..203: mol_type = other DNA

SEQ ID NO: 31180 - DNA, 203 bp, Homo sapiens; identical to SEQ ID NO: 7681
  source 1..203: mol_type = other DNA

SEQ ID NO: 31181 - DNA, 203 bp, Homo sapiens; identical to SEQ ID NO: 7682
  source 1..203: mol_type = other DNA

SEQ ID NO: 31182 - DNA, 203 bp, Homo sapiens; identical to SEQ ID NO: 7694
  source 1..203: mol_type = other DNA

SEQ ID NO: 31183 - DNA, 203 bp, Homo sapiens; identical to SEQ ID NO: 7695
  source 1..203: mol_type = other DNA

SEQ ID NO: 31184 - DNA, 203 bp, Homo sapiens; identical to SEQ ID NO: 7696
  source 1..203: mol_type = other DNA

SEQ ID NO: 31185 - DNA, 203 bp, Homo sapiens; identical to SEQ ID NO: 7697
  source 1..203: mol_type = other DNA

SEQ ID NO: 31186 - DNA, 203 bp, Homo sapiens; identical to SEQ ID NO: 7698
  source 1..203: mol_type = other DNA

SEQ ID NO: 31187 - DNA, 203 bp, Homo sapiens; identical to SEQ ID NO: 7699
  source 1..203: mol_type = other DNA

SEQ ID NO: 31188 - DNA, 203 bp, Homo sapiens; identical to SEQ ID NO: 7700
  source 1..203: mol_type = other DNA

SEQ ID NO: 31189 - DNA, 203 bp, Homo sapiens; identical to SEQ ID NO: 7701
  source 1..203: mol_type = other DNA

SEQ ID NO: 31190 - DNA, 203 bp, Homo sapiens; identical to SEQ ID NO: 7702
  source 1..203: mol_type = other DNA

SEQ ID NO: 31191 - DNA, 203 bp, Homo sapiens; identical to SEQ ID NO: 7703
  source 1..203: mol_type = other DNA

SEQ ID NO: 31192 - DNA, 203 bp, Homo sapiens; identical to SEQ ID NO: 7704
  source 1..203: mol_type = other DNA

SEQ ID NO: 31193 - DNA, 203 bp, Homo sapiens; identical to SEQ ID NO: 7705
  source 1..203: mol_type = other DNA

SEQ ID NO: 31194 - DNA, 203 bp, Homo sapiens; identical to SEQ ID NO: 7706
  source 1..203: mol_type = other DNA

SEQ ID NO: 31195 - DNA, 203 bp, Homo sapiens; identical to SEQ ID NO: 7707
  source 1..203: mol_type = other DNA

SEQ ID NO: 31196 - DNA, 203 bp, Homo sapiens; identical to SEQ ID NO: 7708
  source 1..203: mol_type = other DNA

SEQ ID NO: 31197 - DNA, 203 bp, Homo sapiens; identical to SEQ ID NO: 7709
  source 1..203: mol_type = other DNA

SEQ ID NO: 31198 - DNA, 203 bp, Homo sapiens; identical to SEQ ID NO: 7710
  source 1..203: mol_type = other DNA

SEQ ID NO: 31199 - DNA, 203 bp, Homo sapiens; identical to SEQ ID NO: 7711
  source 1..203: mol_type = other DNA

SEQ ID NO: 31200 - DNA, 203 bp, Homo sapiens; identical to SEQ ID NO: 7712
  source 1..203: mol_type = other DNA

SEQ ID NO: 31201 - DNA, 203 bp, Homo sapiens; identical to SEQ ID NO: 7713
  source 1..203: mol_type = other DNA

SEQ ID NO: 31202 - DNA, 203 bp, Homo sapiens; identical to SEQ ID NO: 7714
  source 1..203: mol_type = other DNA

SEQ ID NO: 31203 - DNA, 203 bp, Homo sapiens; identical to SEQ ID NO: 7715
  source 1..203: mol_type = other DNA

SEQ ID NO: 31204 - DNA, 203 bp, Homo sapiens; identical to SEQ ID NO: 7716
  source 1..203: mol_type = other DNA

SEQ ID NO: 31205 - DNA, 203 bp, Homo sapiens; identical to SEQ ID NO: 7717
  source 1..203: mol_type = other DNA

SEQ ID NO: 31206 - DNA, 203 bp, Homo sapiens; identical to SEQ ID NO: 7718
  source 1..203: mol_type = other DNA

SEQ ID NO: 31207 - DNA, 203 bp, Homo sapiens; identical to SEQ ID NO: 7720
  source 1..203: mol_type = other DNA

SEQ ID NO: 31208 - DNA, 203 bp, Homo sapiens; identical to SEQ ID NO: 7724
  source 1..203: mol_type = other DNA

SEQ ID NO: 31209 - DNA, 203 bp, Homo sapiens; identical to SEQ ID NO: 7725
  source 1..203: mol_type = other DNA

SEQ ID NO: 31210 - DNA, 203 bp, Homo sapiens; identical to SEQ ID NO: 7726
  source 1..203: mol_type = other DNA

SEQ ID NO: 31211 - DNA, 203 bp, Homo sapiens; identical to SEQ ID NO: 7727
  source 1..203: mol_type = other DNA

SEQ ID NO: 31212 - DNA, 203 bp, Homo sapiens; identical to SEQ ID NO: 7728
  source 1..203: mol_type = other DNA

SEQ ID NO: 31213 - DNA, 203 bp, Homo sapiens; identical to SEQ ID NO: 7729
  source 1..203: mol_type = other DNA

SEQ ID NO: 31214 - DNA, 203 bp, Homo sapiens; identical to SEQ ID NO: 7730
  source 1..203: mol_type = other DNA

SEQ ID NO: 31215 - DNA, 203 bp, Homo sapiens; identical to SEQ ID NO: 7731
  source 1..203: mol_type = other DNA

SEQ ID NO: 31216 - DNA, 203 bp, Homo sapiens; identical to SEQ ID NO: 7732
  source 1..203: mol_type = other DNA

SEQ ID NO: 31217 - DNA, 203 bp, Homo sapiens; identical to SEQ ID NO: 7733
  source 1..203: mol_type = other DNA

SEQ ID NO: 31218 - DNA, 203 bp, Homo sapiens; identical to SEQ ID NO: 7734
  source 1..203: mol_type = other DNA

SEQ ID NO: 31219 - DNA, 203 bp, Homo sapiens; identical to SEQ ID NO: 7735
  source 1..203: mol_type = other DNA

SEQ ID NO: 31220 - DNA, 203 bp, Homo sapiens; identical to SEQ ID NO: 7736
  source 1..203: mol_type = other DNA

SEQ ID NO: 31221 - DNA, 203 bp, Homo sapiens; identical to SEQ ID NO: 7748
  source 1..203: mol_type = other DNA

SEQ ID NO: 31222 - DNA, 203 bp, Homo sapiens; identical to SEQ ID NO: 7771
  source 1..203: mol_type = other DNA

SEQ ID NO: 31223 - DNA, 203 bp, Homo sapiens; identical to SEQ ID NO: 7805
  source 1..203: mol_type = other DNA

SEQ ID NO: 31224 - DNA, 203 bp, Homo sapiens; identical to SEQ ID NO: 7806
  source 1..203: mol_type = other DNA

SEQ ID NO: 31225 - DNA, 203 bp, Homo sapiens; identical to SEQ ID NO: 7807
  source 1..203: mol_type = other DNA

SEQ ID NO: 31226 - DNA, 203 bp, Homo sapiens; identical to SEQ ID NO: 7808
  source 1..203: mol_type = other DNA

SEQ ID NO: 31227 - DNA, 203 bp, Homo sapiens; identical to SEQ ID NO: 7809
  source 1..203: mol_type = other DNA

SEQ ID NO: 31228 - DNA, 203 bp, Homo sapiens; identical to SEQ ID NO: 7810
  source 1..203: mol_type = other DNA

SEQ ID NO: 31229 - DNA, 203 bp, Homo sapiens; identical to SEQ ID NO: 7811
  source 1..203: mol_type = other DNA

SEQ ID NO: 31230 - DNA, 203 bp, Homo sapiens; identical to SEQ ID NO: 7812
  source 1..203: mol_type = other DNA

SEQ ID NO: 31231 - DNA, 203 bp, Homo sapiens; identical to SEQ ID NO: 7813
  source 1..203: mol_type = other DNA

SEQ ID NO: 31232 - DNA, 203 bp, Homo sapiens; identical to SEQ ID NO: 7814
  source 1..203: mol_type = other DNA

SEQ ID NO: 31233 - DNA, 203 bp, Homo sapiens; identical to SEQ ID NO: 7815
  source 1..203: mol_type = other DNA

SEQ ID NO: 31234 - DNA, 203 bp, Homo sapiens; identical to SEQ ID NO: 7816
  source 1..203: mol_type = other DNA

SEQ ID NO: 31235 - DNA, 203 bp, Homo sapiens; identical to SEQ ID NO: 7817
  source 1..203: mol_type = other DNA

SEQ ID NO: 31236 - DNA, 203 bp, Homo sapiens; identical to SEQ ID NO: 7818
  source 1..203: mol_type = other DNA

SEQ ID NO: 31237 - DNA, 203 bp, Homo sapiens; identical to SEQ ID NO: 7843
  source 1..203: mol_type = other DNA

SEQ ID NO: 31238 - DNA, 203 bp, Homo sapiens; identical to SEQ ID NO: 7845
  source 1..203: mol_type = other DNA

SEQ ID NO: 31239 - DNA, 203 bp, Homo sapiens; identical to SEQ ID NO: 7846
  source 1..203: mol_type = other DNA

SEQ ID NO: 31240 - DNA, 203 bp, Homo sapiens; identical to SEQ ID NO: 7847
  source 1..203: mol_type = other DNA

SEQ ID NO: 31241 - DNA, 203 bp, Homo sapiens; identical to SEQ ID NO: 7848
  source 1..203: mol_type = other DNA

SEQ ID NO: 31242 - DNA, 203 bp, Homo sapiens; identical to SEQ ID NO: 7849
  source 1..203: mol_type = other DNA

SEQ ID NO: 31243 - DNA, 203 bp, Homo sapiens; identical to SEQ ID NO: 7850
  source 1..203: mol_type = other DNA

SEQ ID NO: 31244 - DNA, 203 bp, Homo sapiens; identical to SEQ ID NO: 7851
  source 1..203: mol_type = other DNA

SEQ ID NO: 31245 - DNA, 203 bp, Homo sapiens; identical to SEQ ID NO: 7852
  source 1..203: mol_type = other DNA

SEQ ID NO: 31246 - DNA, 203 bp, Homo sapiens; identical to SEQ ID NO: 7853
  source 1..203: mol_type = other DNA

SEQ ID NO: 31247 - DNA, 203 bp, Homo sapiens; identical to SEQ ID NO: 7854
  source 1..203: mol_type = other DNA

SEQ ID NO: 31248 - DNA, 203 bp, Homo sapiens; identical to SEQ ID NO: 7855
  source 1..203: mol_type = other DNA

SEQ ID NO: 31249 - DNA, 203 bp, Homo sapiens; identical to SEQ ID NO: 7856
  source 1..203: mol_type = other DNA

SEQ ID NO: 31250 - DNA, 203 bp, Homo sapiens; identical to SEQ ID NO: 7857
  source 1..203: mol_type = other DNA

SEQ ID NO: 31251 - DNA, 203 bp, Homo sapiens; identical to SEQ ID NO: 7858
  source 1..203: mol_type = other DNA

SEQ ID NO: 31252 - DNA, 203 bp, Homo sapiens; identical to SEQ ID NO: 7859
  source 1..203: mol_type = other DNA

SEQ ID NO: 31253 - DNA, 203 bp, Homo sapiens; identical to SEQ ID NO: 7865
  source 1..203: mol_type = other DNA

SEQ ID NO: 31254 - DNA, 203 bp, Homo sapiens; identical to SEQ ID NO: 7899
  source 1..203: mol_type = other DNA

SEQ ID NO: 31255 - DNA, 203 bp, Homo sapiens; identical to SEQ ID NO: 7903
  source 1..203: mol_type = other DNA

SEQ ID NO: 31256 - DNA, 203 bp, Homo sapiens; identical to SEQ ID NO: 7907
  source 1..203: mol_type = other DNA

SEQ ID NO: 31257 - DNA, 203 bp, Homo sapiens; identical to SEQ ID NO: 7910
  source 1..203: mol_type = other DNA

SEQ ID NO: 31258 - DNA, 203 bp, Homo sapiens; identical to SEQ ID NO: 7912
  source 1..203: mol_type = other DNA

SEQ ID NO: 31259 - DNA, 203 bp, Homo sapiens; identical to SEQ ID NO: 7913
  source 1..203: mol_type = other DNA

SEQ ID NO: 31260 - DNA, 203 bp, Homo sapiens; identical to SEQ ID NO: 7917
  source 1..203: mol_type = other DNA

SEQ ID NO: 31261 - DNA, 203 bp, Homo sapiens; identical to SEQ ID NO: 7919
  source 1..203: mol_type = other DNA

SEQ ID NO: 31262 - DNA, 203 bp, Homo sapiens; identical to SEQ ID NO: 7920
  source 1..203: mol_type = other DNA

SEQ ID NO: 31263 - DNA, 203 bp, Homo sapiens; identical to SEQ ID NO: 7921
  source 1..203: mol_type = other DNA

SEQ ID NO: 31264 - DNA, 203 bp, Homo sapiens; identical to SEQ ID NO: 7926
  source 1..203: mol_type = other DNA

SEQ ID NO: 31265 - DNA, 203 bp, Homo sapiens; identical to SEQ ID NO: 7927
  source 1..203: mol_type = other DNA

SEQ ID NO: 31266 - DNA, 203 bp, Homo sapiens; identical to SEQ ID NO: 7928
  source 1..203: mol_type = other DNA

SEQ ID NO: 31267 - DNA, 203 bp, Homo sapiens; identical to SEQ ID NO: 7929
  source 1..203: mol_type = other DNA

SEQ ID NO: 31268 - DNA, 203 bp, Homo sapiens; identical to SEQ ID NO: 7930
  source 1..203: mol_type = other DNA

SEQ ID NO: 31269 - DNA, 203 bp, Homo sapiens; identical to SEQ ID NO: 7931
  source 1..203: mol_type = other DNA

SEQ ID NO: 31270 - DNA, 203 bp, Homo sapiens; identical to SEQ ID NO: 7932
  source 1..203: mol_type = other DNA

SEQ ID NO: 31271 - DNA, 203 bp, Homo sapiens; identical to SEQ ID NO: 7933
  source 1..203: mol_type = other DNA

SEQ ID NO: 31272 - DNA, 203 bp, Homo sapiens; identical to SEQ ID NO: 7934
  source 1..203: mol_type = other DNA

SEQ ID NO: 31273 - DNA, 203 bp, Homo sapiens; identical to SEQ ID NO: 7935
  source 1..203: mol_type = other DNA

SEQ ID NO: 31274 - DNA, 203 bp, Homo sapiens; identical to SEQ ID NO: 7936
  source 1..203: mol_type = other DNA

SEQ ID NO: 31275 - DNA, 203 bp, Homo sapiens; identical to SEQ ID NO: 7937
  source 1..203: mol_type = other DNA

SEQ ID NO: 31276 - DNA, 203 bp, Homo sapiens; identical to SEQ ID NO: 7938
  source 1..203: mol_type = other DNA

SEQ ID NO: 31277 - DNA, 203 bp, Homo sapiens; identical to SEQ ID NO: 7939
  source 1..203: mol_type = other DNA

SEQ ID NO: 31278 - DNA, 203 bp, Homo sapiens; identical to SEQ ID NO: 7940
  source 1..203: mol_type = other DNA

SEQ ID NO: 31279 - DNA, 203 bp, Homo sapiens; identical to SEQ ID NO: 7941
  source 1..203: mol_type = other DNA

SEQ ID NO: 31280 - DNA, 203 bp, Homo sapiens; identical to SEQ ID NO: 7942
  source 1..203: mol_type = other DNA

SEQ ID NO: 31281 - DNA, 203 bp, Homo sapiens; identical to SEQ ID NO: 7943
  source 1..203: mol_type = other DNA

SEQ ID NO: 31282 - DNA, 203 bp, Homo sapiens; identical to SEQ ID NO: 7944
  source 1..203: mol_type = other DNA

SEQ ID NO: 31283 - DNA, 203 bp, Homo sapiens; identical to SEQ ID NO: 7948
  source 1..203: mol_type = other DNA

SEQ ID NO: 31284 - DNA, 203 bp, Homo sapiens; identical to SEQ ID NO: 7952
  source 1..203: mol_type = other DNA

SEQ ID NO: 31285 - DNA, 203 bp, Homo sapiens; identical to SEQ ID NO: 7958
  source 1..203: mol_type = other DNA

SEQ ID NO: 31286 - DNA, 203 bp, Homo sapiens; identical to SEQ ID NO: 7964
  source 1..203: mol_type = other DNA

SEQ ID NO: 31287 - DNA, 203 bp, Homo sapiens; identical to SEQ ID NO: 7986
  source 1..203: mol_type = other DNA

SEQ ID NO: 31288 - DNA, 203 bp, Homo sapiens; identical to SEQ ID NO: 8014
  source 1..203: mol_type = other DNA

SEQ ID NO: 31289 - DNA, 203 bp, Homo sapiens; identical to SEQ ID NO: 8019
  source 1..203: mol_type = other DNA

SEQ ID NO: 31290 - DNA, 203 bp, Homo sapiens; identical to SEQ ID NO: 8062
  source 1..203: mol_type = other DNA

SEQ ID NO: 31291 - DNA, 203 bp, Homo sapiens; identical to SEQ ID NO: 8063
  source 1..203: mol_type = other DNA

SEQ ID NO: 31292 - DNA, 203 bp, Homo sapiens; identical to SEQ ID NO: 8064
  source 1..203: mol_type = other DNA

SEQ ID NO: 31293 - DNA, 203 bp, Homo sapiens; identical to SEQ ID NO: 8065
  source 1..203: mol_type = other DNA

SEQ ID NO: 31294 - DNA, 203 bp, Homo sapiens; identical to SEQ ID NO: 8066
  source 1..203: mol_type = other DNA

SEQ ID NO: 31295 - DNA, 203 bp, Homo sapiens; identical to SEQ ID NO: 8067
  source 1..203: mol_type = other DNA

SEQ ID NO: 31296 - DNA, 203 bp, Homo sapiens; identical to SEQ ID NO: 8068
  source 1..203: mol_type = other DNA

SEQ ID NO: 31297 - DNA, 203 bp, Homo sapiens; identical to SEQ ID NO: 8069
  source 1..203: mol_type = other DNA

SEQ ID NO: 31298 - DNA, 203 bp, Homo sapiens; identical to SEQ ID NO: 8070
  source 1..203: mol_type = other DNA

SEQ ID NO: 31299 - DNA, 203 bp, Homo sapiens; identical to SEQ ID NO: 8071
  source 1..203: mol_type = other DNA

SEQ ID NO: 31300 - DNA, 203 bp, Homo sapiens; identical to SEQ ID NO: 8072
  source 1..203: mol_type = other DNA

SEQ ID NO: 31301 - DNA, 203 bp, Homo sapiens; identical to SEQ ID NO: 8073
  source 1..203: mol_type = other DNA

SEQ ID NO: 31302 - DNA, 203 bp, Homo sapiens; identical to SEQ ID NO: 8076
  source 1..203: mol_type = other DNA

SEQ ID NO: 31303 - DNA, 203 bp, Homo sapiens; identical to SEQ ID NO: 8077
  source 1..203: mol_type = other DNA

SEQ ID NO: 31304 - DNA, 203 bp, Homo sapiens; identical to SEQ ID NO: 8078
  source 1..203: mol_type = other DNA

SEQ ID NO: 31305 - DNA, 203 bp, Homo sapiens; identical to SEQ ID NO: 8079
  source 1..203: mol_type = other DNA

SEQ ID NO: 31306 - DNA, 203 bp, Homo sapiens; identical to SEQ ID NO: 8080
  source 1..203: mol_type = other DNA

SEQ ID NO: 31307 - DNA, 203 bp, Homo sapiens; identical to SEQ ID NO: 8081
  source 1..203: mol_type = other DNA

SEQ ID NO: 31308 - DNA, 203 bp, Homo sapiens; identical to SEQ ID NO: 8082
  source 1..203: mol_type = other DNA

SEQ ID NO: 31309 - DNA, 203 bp, Homo sapiens; identical to SEQ ID NO: 8083
  source 1..203: mol_type = other DNA

SEQ ID NO: 31310 - DNA, 203 bp, Homo sapiens; identical to SEQ ID NO: 8084
  source 1..203: mol_type = other DNA

SEQ ID NO: 31311 - DNA, 203 bp, Homo sapiens; identical to SEQ ID NO: 8085
  source 1..203: mol_type = other DNA

SEQ ID NO: 31312 - DNA, 203 bp, Homo sapiens; identical to SEQ ID NO: 8086
  source 1..203: mol_type = other DNA

SEQ ID NO: 31313 - DNA, 203 bp, Homo sapiens; identical to SEQ ID NO: 8087
  source 1..203: mol_type = other DNA

SEQ ID NO: 31314 - DNA, 203 bp, Homo sapiens; identical to SEQ ID NO: 8088
  source 1..203: mol_type = other DNA

SEQ ID NO: 31315 - DNA, 203 bp, Homo sapiens; identical to SEQ ID NO: 8089
  source 1..203: mol_type = other DNA

SEQ ID NO: 31316 - DNA, 203 bp, Homo sapiens; identical to SEQ ID NO: 8104
  source 1..203: mol_type = other DNA

SEQ ID NO: 31317 - DNA, 203 bp, Homo sapiens; identical to SEQ ID NO: 8105
  source 1..203: mol_type = other DNA

SEQ ID NO: 31318 - DNA, 203 bp, Homo sapiens; identical to SEQ ID NO: 8106
  source 1..203: mol_type = other DNA

SEQ ID NO: 31319 - DNA, 203 bp, Homo sapiens; identical to SEQ ID NO: 8107
  source 1..203: mol_type = other DNA

SEQ ID NO: 31320 - DNA, 203 bp, Homo sapiens; identical to SEQ ID NO: 8108
  source 1..203: mol_type = other DNA

SEQ ID NO: 31321 - DNA, 203 bp, Homo sapiens; identical to SEQ ID NO: 8109
  source 1..203: mol_type = other DNA

SEQ ID NO: 31322 - DNA, 203 bp, Homo sapiens; identical to SEQ ID NO: 8110
  source 1..203: mol_type = other DNA

SEQ ID NO: 31323 - DNA, 203 bp, Homo sapiens; identical to SEQ ID NO: 8111
  source 1..203: mol_type = other DNA

SEQ ID NO: 31324 - DNA, 203 bp, Homo sapiens; identical to SEQ ID NO: 8112
  source 1..203: mol_type = other DNA

SEQ ID NO: 31325 - DNA, 203 bp, Homo sapiens; identical to SEQ ID NO: 8113
  source 1..203: mol_type = other DNA

SEQ ID NO: 31326 - DNA, 203 bp, Homo sapiens; identical to SEQ ID NO: 8138
  source 1..203: mol_type = other DNA

SEQ ID NO: 31327 - DNA, 203 bp, Homo sapiens; identical to SEQ ID NO: 8139
  source 1..203: mol_type = other DNA

SEQ ID NO: 31328 - DNA, 203 bp, Homo sapiens; identical to SEQ ID NO: 8140
  source 1..203: mol_type = other DNA

SEQ ID NO: 31329 - DNA, 203 bp, Homo sapiens; identical to SEQ ID NO: 8141
  source 1..203: mol_type = other DNA

SEQ ID NO: 31330 - DNA, 203 bp, Homo sapiens; identical to SEQ ID NO: 8142
  source 1..203: mol_type = other DNA

SEQ ID NO: 31331 - DNA, 203 bp, Homo sapiens; identical to SEQ ID NO: 8143
  source 1..203: mol_type = other DNA

SEQ ID NO: 31332 - DNA, 203 bp, Homo sapiens; identical to SEQ ID NO: 8144
  source 1..203: mol_type = other DNA

SEQ ID NO: 31333 - DNA, 203 bp, Homo sapiens; identical to SEQ ID NO: 8145
  source 1..203: mol_type = other DNA

SEQ ID NO: 31334 - DNA, 203 bp, Homo sapiens; identical to SEQ ID NO: 8146
  source 1..203: mol_type = other DNA

SEQ ID NO: 31335 - DNA, 203 bp, Homo sapiens; identical to SEQ ID NO: 8147
  source 1..203: mol_type = other DNA

SEQ ID NO: 31336 - DNA, 203 bp, Homo sapiens; identical to SEQ ID NO: 8148
  source 1..203: mol_type = other DNA

SEQ ID NO: 31337 - DNA, 203 bp, Homo sapiens; identical to SEQ ID NO: 8149
  source 1..203: mol_type = other DNA

SEQ ID NO: 31338 - DNA, 203 bp, Homo sapiens; identical to SEQ ID NO: 8150
  source 1..203: mol_type = other DNA

SEQ ID NO: 31339 - DNA, 203 bp, Homo sapiens; identical to SEQ ID NO: 8151
  source 1..203: mol_type = other DNA

SEQ ID NO: 31340 - DNA, 203 bp, Homo sapiens; identical to SEQ ID NO: 8152
  source 1..203: mol_type = other DNA

SEQ ID NO: 31341 - DNA, 203 bp, Homo sapiens; identical to SEQ ID NO: 8153
  source 1..203: mol_type = other DNA

SEQ ID NO: 31342 - DNA, 203 bp, Homo sapiens; identical to SEQ ID NO: 8154
  source 1..203: mol_type = other DNA

SEQ ID NO: 31343 - DNA, 203 bp, Homo sapiens; identical to SEQ ID NO: 8155
  source 1..203: mol_type = other DNA

SEQ ID NO: 31344 - DNA, 203 bp, Homo sapiens; identical to SEQ ID NO: 8156
  source 1..203: mol_type = other DNA

SEQ ID NO: 31345 - DNA, 203 bp, Homo sapiens; identical to SEQ ID NO: 8157
  source 1..203: mol_type = other DNA

SEQ ID NO: 31346 - DNA, 203 bp, Homo sapiens; identical to SEQ ID NO: 8158
  source 1..203: mol_type = other DNA

SEQ ID NO: 31347 - DNA, 203 bp, Homo sapiens; identical to SEQ ID NO: 8159
  source 1..203: mol_type = other DNA

SEQ ID NO: 31348 - DNA, 203 bp, Homo sapiens; identical to SEQ ID NO: 8160
  source 1..203: mol_type = other DNA

SEQ ID NO: 31349 - DNA, 203 bp, Homo sapiens; identical to SEQ ID NO: 8169
  source 1..203: mol_type = other DNA

SEQ ID NO: 31350 - DNA, 203 bp, Homo sapiens; identical to SEQ ID NO: 8171
  source 1..203: mol_type = other DNA

SEQ ID NO: 31351 - DNA, 203 bp, Homo sapiens; identical to SEQ ID NO: 8173
  source 1..203: mol_type = other DNA

SEQ ID NO: 31352 - DNA, 203 bp, Homo sapiens; identical to SEQ ID NO: 8193
  source 1..203: mol_type = other DNA

SEQ ID NO: 31353 - DNA, 203 bp, Homo sapiens; identical to SEQ ID NO: 8196
  source 1..203: mol_type = other DNA

SEQ ID NO: 31354 - DNA, 203 bp, Homo sapiens; identical to SEQ ID NO: 8199
  source 1..203: mol_type = other DNA

SEQ ID NO: 31355 - DNA, 203 bp, Homo sapiens; identical to SEQ ID NO: 8225
  source 1..203: mol_type = other DNA

SEQ ID NO: 31356 - DNA, 203 bp, Homo sapiens; identical to SEQ ID NO: 8239
  source 1..203: mol_type = other DNA

SEQ ID NO: 31357 - DNA, 203 bp, Homo sapiens; identical to SEQ ID NO: 8266
  source 1..203: mol_type = other DNA

SEQ ID NO: 31358 - DNA, 203 bp, Homo sapiens; identical to SEQ ID NO: 8269
  source 1..203: mol_type = other DNA

SEQ ID NO: 31359 - DNA, 203 bp, Homo sapiens; identical to SEQ ID NO: 8270
  source 1..203: mol_type = other DNA

SEQ ID NO: 31360 - DNA, 203 bp, Homo sapiens; identical to SEQ ID NO: 8271
  source 1..203: mol_type = other DNA

SEQ ID NO: 31361 - DNA, 203 bp, Homo sapiens; identical to SEQ ID NO: 8272
  source 1..203: mol_type = other DNA

SEQ ID NO: 31362 - DNA, 203 bp, Homo sapiens; identical to SEQ ID NO: 8273
  source 1..203: mol_type = other DNA

SEQ ID NO: 31363 - DNA, 203 bp, Homo sapiens; identical to SEQ ID NO: 8274
  source 1..203: mol_type = other DNA

SEQ ID NO: 31364 - DNA, 203 bp, Homo sapiens; identical to SEQ ID NO: 8275
  source 1..203: mol_type = other DNA

SEQ ID NO: 31365 - DNA, 203 bp, Homo sapiens; identical to SEQ ID NO: 8276
  source 1..203: mol_type = other DNA

SEQ ID NO: 31366 - DNA, 203 bp, Homo sapiens; identical to SEQ ID NO: 8277
  source 1..203: mol_type = other DNA

SEQ ID NO: 31367 - DNA, 203 bp, Homo sapiens; identical to SEQ ID NO: 8278
  source 1..203: mol_type = other DNA

SEQ ID NO: 31368 - DNA, 203 bp, Homo sapiens; identical to SEQ ID NO: 8279
  source 1..203: mol_type = other DNA

SEQ ID NO: 31369 - DNA, 203 bp, Homo sapiens; identical to SEQ ID NO: 8280
  source 1..203: mol_type = other DNA

SEQ ID NO: 31370 - DNA, 203 bp, Homo sapiens; identical to SEQ ID NO: 8281
  source 1..203: mol_type = other DNA

SEQ ID NO: 31371 - DNA, 203 bp, Homo sapiens; identical to SEQ ID NO: 8282
  source 1..203: mol_type = other DNA

SEQ ID NO: 31372 - DNA, 203 bp, Homo sapiens; identical to SEQ ID NO: 8283
  source 1..203: mol_type = other DNA

SEQ ID NO: 31373 - DNA, 203 bp, Homo sapiens; identical to SEQ ID NO: 8284
  source 1..203: mol_type = other DNA

SEQ ID NO: 31374 - DNA, 203 bp, Homo sapiens; identical to SEQ ID NO: 8295
  source 1..203: mol_type = other DNA

SEQ ID NO: 31375 - DNA, 203 bp, Homo sapiens; identical to SEQ ID NO: 8315
  source 1..203: mol_type = other DNA

SEQ ID NO: 31376 - DNA, 203 bp, Homo sapiens; identical to SEQ ID NO: 8329
  source 1..203: mol_type = other DNA

SEQ ID NO: 31377 - DNA, 203 bp, Homo sapiens; identical to SEQ ID NO: 8331
  source 1..203: mol_type = other DNA

SEQ ID NO: 31378 - DNA, 203 bp, Homo sapiens; identical to SEQ ID NO: 8332
  source 1..203: mol_type = other DNA

SEQ ID NO: 31379 - DNA, 203 bp, Homo sapiens; identical to SEQ ID NO: 8333
  source 1..203: mol_type = other DNA

SEQ ID NO: 31380 - DNA, 203 bp, Homo sapiens; identical to SEQ ID NO: 8334
  source 1..203: mol_type = other DNA

SEQ ID NO: 31381 - DNA, 203 bp, Homo sapiens; identical to SEQ ID NO: 8335
  source 1..203: mol_type = other DNA

SEQ ID NO: 31382 - DNA, 203 bp, Homo sapiens; identical to SEQ ID NO: 8336
  source 1..203: mol_type = other DNA

SEQ ID NO: 31383 - DNA, 203 bp, Homo sapiens; identical to SEQ ID NO: 8337
  source 1..203: mol_type = other DNA

SEQ ID NO: 31384 - DNA, 203 bp, Homo sapiens; identical to SEQ ID NO: 8338
  source 1..203: mol_type = other DNA

SEQ ID NO: 31385 - DNA, 203 bp, Homo sapiens; identical to SEQ ID NO: 8339
  source 1..203: mol_type = other DNA

SEQ ID NO: 31386 - DNA, 203 bp, Homo sapiens; identical to SEQ ID NO: 8340
  source 1..203: mol_type = other DNA

SEQ ID NO: 31387 - DNA, 203 bp, Homo sapiens; identical to SEQ ID NO: 8341
  source 1..203: mol_type = other DNA

SEQ ID NO: 31388 - DNA, 203 bp, Homo sapiens; identical to SEQ ID NO: 8342
  source 1..203: mol_type = other DNA

SEQ ID NO: 31389 - DNA, 203 bp, Homo sapiens; identical to SEQ ID NO: 8368
  source 1..203: mol_type = other DNA

SEQ ID NO: 31390 - DNA, 203 bp, Homo sapiens; identical to SEQ ID NO: 8369
  source 1..203: mol_type = other DNA

SEQ ID NO: 31391 - DNA, 203 bp, Homo sapiens; identical to SEQ ID NO: 8370
  source 1..203: mol_type = other DNA

SEQ ID NO: 31392 - DNA, 203 bp, Homo sapiens; identical to SEQ ID NO: 8371
  source 1..203: mol_type = other DNA

SEQ ID NO: 31393 - DNA, 203 bp, Homo sapiens; identical to SEQ ID NO: 8372
  source 1..203: mol_type = other DNA

SEQ ID NO: 31394 - DNA, 203 bp, Homo sapiens; identical to SEQ ID NO: 8373
  source 1..203: mol_type = other DNA

SEQ ID NO: 31395 - DNA, 203 bp, Homo sapiens; identical to SEQ ID NO: 8374
  source 1..203: mol_type = other DNA

SEQ ID NO: 31396 - DNA, 203 bp, Homo sapiens; identical to SEQ ID NO: 8375
  source 1..203: mol_type = other DNA

SEQ ID NO: 31397 - DNA, 203 bp, Homo sapiens; identical to SEQ ID NO: 8379
  source 1..203: mol_type = other DNA

SEQ ID NO: 31398 - DNA, 203 bp, Homo sapiens; identical to SEQ ID NO: 8380
  source 1..203: mol_type = other DNA

SEQ ID NO: 31399 - DNA, 203 bp, Homo sapiens; identical to SEQ ID NO: 8381
  source 1..203: mol_type = other DNA

SEQ ID NO: 31400 - DNA, 203 bp, Homo sapiens; identical to SEQ ID NO: 8382
  source 1..203: mol_type = other DNA

SEQ ID NO: 31401 - DNA, 203 bp, Homo sapiens; identical to SEQ ID NO: 8383
  source 1..203: mol_type = other DNA

SEQ ID NO: 31402 - DNA, 203 bp, Homo sapiens; identical to SEQ ID NO: 8384
  source 1..203: mol_type = other DNA

SEQ ID NO: 31403 - DNA, 203 bp, Homo sapiens; identical to SEQ ID NO: 8385
  source 1..203: mol_type = other DNA

SEQ ID NO: 31404 - DNA, 203 bp, Homo sapiens; identical to SEQ ID NO: 8386
  source 1..203: mol_type = other DNA

SEQ ID NO: 31405 - DNA, 203 bp, Homo sapiens; identical to SEQ ID NO: 8387
  source 1..203: mol_type = other DNA

SEQ ID NO: 31406 - DNA, 203 bp, Homo sapiens; identical to SEQ ID NO: 8388
  source 1..203: mol_type = other DNA

SEQ ID NO: 31407 - DNA, 203 bp, Homo sapiens; identical to SEQ ID NO: 8407
  source 1..203: mol_type = other DNA

SEQ ID NO: 31408 - DNA, 203 bp, Homo sapiens; identical to SEQ ID NO: 8422
  source 1..203: mol_type = other DNA

SEQ ID NO: 31409 - DNA, 203 bp, Homo sapiens; identical to SEQ ID NO: 8442
  source 1..203: mol_type = other DNA

SEQ ID NO: 31410 - DNA, 203 bp, Homo sapiens; identical to SEQ ID NO: 8451
  source 1..203: mol_type = other DNA

SEQ ID NO: 31411 - DNA, 203 bp, Homo sapiens; identical to SEQ ID NO: 8469
  source 1..203: mol_type = other DNA

SEQ ID NO: 31412 - DNA, 203 bp, Homo sapiens; identical to SEQ ID NO: 8490
  source 1..203: mol_type = other DNA

SEQ ID NO: 31413 - DNA, 203 bp, Homo sapiens; identical to SEQ ID NO: 8493
  source 1..203: mol_type = other DNA

SEQ ID NO: 31414 - DNA, 203 bp, Homo sapiens; identical to SEQ ID NO: 8506
  source 1..203: mol_type = other DNA

SEQ ID NO: 31415 - DNA, 203 bp, Homo sapiens; identical to SEQ ID NO: 8538
  source 1..203: mol_type = other DNA

SEQ ID NO: 31416 - DNA, 203 bp, Homo sapiens; identical to SEQ ID NO: 8539
  source 1..203: mol_type = other DNA

SEQ ID NO: 31417 - DNA, 203 bp, Homo sapiens; identical to SEQ ID NO: 8540
  source 1..203: mol_type = other DNA

SEQ ID NO: 31418 - DNA, 203 bp, Homo sapiens; identical to SEQ ID NO: 8541
  source 1..203: mol_type = other DNA

SEQ ID NO: 31419 - DNA, 203 bp, Homo sapiens; identical to SEQ ID NO: 8542
  source 1..203: mol_type = other DNA

SEQ ID NO: 31420 - DNA, 203 bp, Homo sapiens; identical to SEQ ID NO: 8543
  source 1..203: mol_type = other DNA

SEQ ID NO: 31421 - DNA, 203 bp, Homo sapiens; identical to SEQ ID NO: 8544
  source 1..203: mol_type = other DNA

SEQ ID NO: 31422 - DNA, 203 bp, Homo sapiens; identical to SEQ ID NO: 8545
  source 1..203: mol_type = other DNA

SEQ ID NO: 31423 - DNA, 203 bp, Homo sapiens; identical to SEQ ID NO: 8546
  source 1..203: mol_type = other DNA

SEQ ID NO: 31424 - DNA, 203 bp, Homo sapiens; identical to SEQ ID NO: 8547
  source 1..203: mol_type = other DNA

SEQ ID NO: 31425 - DNA, 203 bp, Homo sapiens; identical to SEQ ID NO: 8548
  source 1..203: mol_type = other DNA

SEQ ID NO: 31426 - DNA, 203 bp, Homo sapiens; identical to SEQ ID NO: 8549
  source 1..203: mol_type = other DNA

SEQ ID NO: 31427 - DNA, 203 bp, Homo sapiens; identical to SEQ ID NO: 8577
  source 1..203: mol_type = other DNA

SEQ ID NO: 31428 - DNA, 203 bp, Homo sapiens; identical to SEQ ID NO: 8578
  source 1..203: mol_type = other DNA

SEQ ID NO: 31429 - DNA, 203 bp, Homo sapiens; identical to SEQ ID NO: 8579
  source 1..203: mol_type = other DNA

SEQ ID NO: 31430 - DNA, 203 bp, Homo sapiens; identical to SEQ ID NO: 8580
  source 1..203: mol_type = other DNA

SEQ ID NO: 31431 - DNA, 203 bp, Homo sapiens; identical to SEQ ID NO: 8581
  source 1..203: mol_type = other DNA

SEQ ID NO: 31432 - DNA, 203 bp, Homo sapiens; identical to SEQ ID NO: 8582
  source 1..203: mol_type = other DNA

SEQ ID NO: 31433 - DNA, 203 bp, Homo sapiens; identical to SEQ ID NO: 8583
  source 1..203: mol_type = other DNA

SEQ ID NO: 31434 - DNA, 203 bp, Homo sapiens; identical to SEQ ID NO: 8584
  source 1..203: mol_type = other DNA

SEQ ID NO: 31435 - DNA, 203 bp, Homo sapiens; identical to SEQ ID NO: 8585
  source 1..203: mol_type = other DNA

SEQ ID NO: 31436 - DNA, 203 bp, Homo sapiens; identical to SEQ ID NO: 8586
  source 1..203: mol_type = other DNA

SEQ ID NO: 31437 - DNA, 203 bp, Homo sapiens; identical to SEQ ID NO: 8587
  source 1..203: mol_type = other DNA

SEQ ID NO: 31438 - DNA, 203 bp, Homo sapiens; identical to SEQ ID NO: 8588
  source 1..203: mol_type = other DNA

SEQ ID NO: 31439 - DNA, 203 bp, Homo sapiens; identical to SEQ ID NO: 8589
  source 1..203: mol_type = other DNA

SEQ ID NO: 31440 - DNA, 203 bp, Homo sapiens; identical to SEQ ID NO: 8590
  source 1..203: mol_type = other DNA

SEQ ID NO: 31441 - DNA, 203 bp, Homo sapiens; identical to SEQ ID NO: 8591
  source 1..203: mol_type = other DNA

SEQ ID NO: 31442 - DNA, 203 bp, Homo sapiens; identical to SEQ ID NO: 8592
  source 1..203: mol_type = other DNA

SEQ ID NO: 31443 - DNA, 203 bp, Homo sapiens; identical to SEQ ID NO: 8593
  source 1..203: mol_type = other DNA

SEQ ID NO: 31444 - DNA, 203 bp, Homo sapiens; identical to SEQ ID NO: 8594
  source 1..203: mol_type = other DNA

SEQ ID NO: 31445 - DNA, 203 bp, Homo sapiens; identical to SEQ ID NO: 8595
  source 1..203: mol_type = other DNA

SEQ ID NO: 31446 - DNA, 203 bp, Homo sapiens; identical to SEQ ID NO: 8596
  source 1..203: mol_type = other DNA

SEQ ID NO: 31447 - DNA, 203 bp, Homo sapiens; identical to SEQ ID NO: 8597
  source 1..203: mol_type = other DNA

SEQ ID NO: 31448 - DNA, 203 bp, Homo sapiens; identical to SEQ ID NO: 8598
  source 1..203: mol_type = other DNA

SEQ ID NO: 31449 - DNA, 203 bp, Homo sapiens; identical to SEQ ID NO: 8599
  source 1..203: mol_type = other DNA

SEQ ID NO: 31450 - DNA, 203 bp, Homo sapiens; identical to SEQ ID NO: 8600
  source 1..203: mol_type = other DNA

SEQ ID NO: 31451 - DNA, 203 bp, Homo sapiens; identical to SEQ ID NO: 8601
  source 1..203: mol_type = other DNA

SEQ ID NO: 31452 - DNA, 203 bp, Homo sapiens; identical to SEQ ID NO: 8602
  source 1..203: mol_type = other DNA

SEQ ID NO: 31453 - DNA, 203 bp, Homo sapiens; identical to SEQ ID NO: 8605
  source 1..203: mol_type = other DNA

SEQ ID NO: 31454 - DNA, 203 bp, Homo sapiens; identical to SEQ ID NO: 8606
  source 1..203: mol_type = other DNA

SEQ ID NO: 31455 - DNA, 203 bp, Homo sapiens; identical to SEQ ID NO: 8607
  source 1..203: mol_type = other DNA

SEQ ID NO: 31456 - DNA, 203 bp, Homo sapiens; identical to SEQ ID NO: 8608
  source 1..203: mol_type = other DNA

SEQ ID NO: 31457 - DNA, 203 bp, Homo sapiens; identical to SEQ ID NO: 8609
  source 1..203: mol_type = other DNA

SEQ ID NO: 31458 - DNA, 203 bp, Homo sapiens; identical to SEQ ID NO: 8610
  source 1..203: mol_type = other DNA

SEQ ID NO: 31459 - DNA, 203 bp, Homo sapiens; identical to SEQ ID NO: 8611
  source 1..203: mol_type = other DNA

SEQ ID NO: 31460 - DNA, 203 bp, Homo sapiens; identical to SEQ ID NO: 8612
  source 1..203: mol_type = other DNA

SEQ ID NO: 31461 - DNA, 203 bp, Homo sapiens; identical to SEQ ID NO: 8613
  source 1..203: mol_type = other DNA

SEQ ID NO: 31462 - DNA, 203 bp, Homo sapiens; identical to SEQ ID NO: 8614
  source 1..203: mol_type = other DNA

SEQ ID NO: 31463 - DNA, 203 bp, Homo sapiens; identical to SEQ ID NO: 8615
  source 1..203: mol_type = other DNA

SEQ ID NO: 31464 - DNA, 203 bp, Homo sapiens; identical to SEQ ID NO: 8616
  source 1..203: mol_type = other DNA

SEQ ID NO: 31465 - DNA, 203 bp, Homo sapiens; identical to SEQ ID NO: 8617
  source 1..203: mol_type = other DNA

SEQ ID NO: 31466 - DNA, 203 bp, Homo sapiens; identical to SEQ ID NO: 8618
  source 1..203: mol_type = other DNA

SEQ ID NO: 31467 - DNA, 203 bp, Homo sapiens; identical to SEQ ID NO: 8619
  source 1..203: mol_type = other DNA

SEQ ID NO: 31468 - DNA, 203 bp, Homo sapiens; identical to SEQ ID NO: 8620
  source 1..203: mol_type = other DNA

SEQ ID NO: 31469 - DNA, 203 bp, Homo sapiens; identical to SEQ ID NO: 8621
  source 1..203: mol_type = other DNA

SEQ ID NO: 31470 - DNA, 203 bp, Homo sapiens; identical to SEQ ID NO: 8632
  source 1..203: mol_type = other DNA

SEQ ID NO: 31471 - DNA, 203 bp, Homo sapiens; identical to SEQ ID NO: 8651
  source 1..203: mol_type = other DNA

SEQ ID NO: 31472 - DNA, 203 bp, Homo sapiens; identical to SEQ ID NO: 8652
  source 1..203: mol_type = other DNA

SEQ ID NO: 31473 - DNA, 203 bp, Homo sapiens; identical to SEQ ID NO: 8653
  source 1..203: mol_type = other DNA

SEQ ID NO: 31474 - DNA, 203 bp, Homo sapiens; identical to SEQ ID NO: 8654
  source 1..203: mol_type = other DNA

SEQ ID NO: 31475 - DNA, 203 bp, Homo sapiens; identical to SEQ ID NO: 8655
  source 1..203: mol_type = other DNA

SEQ ID NO: 31476 - DNA, 203 bp, Homo sapiens; identical to SEQ ID NO: 8656
  source 1..203: mol_type = other DNA

SEQ ID NO: 31477 - DNA, 203 bp, Homo sapiens; identical to SEQ ID NO: 8660
  source 1..203: mol_type = other DNA

SEQ ID NO: 31478 - DNA, 203 bp, Homo sapiens; identical to SEQ ID NO: 8661
  source 1..203: mol_type = other DNA

SEQ ID NO: 31479 - DNA, 203 bp, Homo sapiens; identical to SEQ ID NO: 8662
  source 1..203: mol_type = other DNA

SEQ ID NO: 31480 - DNA, 203 bp, Homo sapiens; identical to SEQ ID NO: 8663
  source 1..203: mol_type = other DNA

SEQ ID NO: 31481 - DNA, 203 bp, Homo sapiens; identical to SEQ ID NO: 8664
  source 1..203: mol_type = other DNA

SEQ ID NO: 31482 - DNA, 203 bp, Homo sapiens; identical to SEQ ID NO: 8665
  source 1..203: mol_type = other DNA

SEQ ID NO: 31483 - DNA, 203 bp, Homo sapiens; identical to SEQ ID NO: 8666
  source 1..203: mol_type = other DNA

SEQ ID NO: 31484 - DNA, 203 bp, Homo sapiens; identical to SEQ ID NO: 8667
  source 1..203: mol_type = other DNA

SEQ ID NO: 31485 - DNA, 203 bp, Homo sapiens; identical to SEQ ID NO: 8668
  source 1..203: mol_type = other DNA

SEQ ID NO: 31486 - DNA, 203 bp, Homo sapiens; identical to SEQ ID NO: 8669
  source 1..203: mol_type = other DNA

SEQ ID NO: 31487 - DNA, 203 bp, Homo sapiens; identical to SEQ ID NO: 8670
  source 1..203: mol_type = other DNA

SEQ ID NO: 31488 - DNA, 203 bp, Homo sapiens; identical to SEQ ID NO: 8679
  source 1..203: mol_type = other DNA

SEQ ID NO: 31489 - DNA, 203 bp, Homo sapiens; identical to SEQ ID NO: 8697
  source 1..203: mol_type = other DNA

SEQ ID NO: 31490 - DNA, 203 bp, Homo sapiens; identical to SEQ ID NO: 8722
  source 1..203: mol_type = other DNA

SEQ ID NO: 31491 - DNA, 203 bp, Homo sapiens; identical to SEQ ID NO: 8723
  source 1..203: mol_type = other DNA

SEQ ID NO: 31492 - DNA, 203 bp, Homo sapiens; identical to SEQ ID NO: 8724
  source 1..203: mol_type = other DNA

SEQ ID NO: 31493 - DNA, 203 bp, Homo sapiens; identical to SEQ ID NO: 8725
  source 1..203: mol_type = other DNA

SEQ ID NO: 31494 - DNA, 203 bp, Homo sapiens; identical to SEQ ID NO: 8726
  source 1..203: mol_type = other DNA

SEQ ID NO: 31495 - DNA, 203 bp, Homo sapiens; identical to SEQ ID NO: 8727
  source 1..203: mol_type = other DNA

SEQ ID NO: 31496 - DNA, 203 bp, Homo sapiens; identical to SEQ ID NO: 8728
  source 1..203: mol_type = other DNA

SEQ ID NO: 31497 - DNA, 203 bp, Homo sapiens; identical to SEQ ID NO: 8729
  source 1..203: mol_type = other DNA

SEQ ID NO: 31498 - DNA, 203 bp, Homo sapiens; identical to SEQ ID NO: 8730
  source 1..203: mol_type = other DNA

SEQ ID NO: 31499 - DNA, 203 bp, Homo sapiens; identical to SEQ ID NO: 8731
  source 1..203: mol_type = other DNA

SEQ ID NO: 31500 - DNA, 203 bp, Homo sapiens; identical to SEQ ID NO: 8732
  source 1..203: mol_type = other DNA

SEQ ID NO: 31501 - DNA, 203 bp, Homo sapiens; identical to SEQ ID NO: 8733
  source 1..203: mol_type = other DNA

SEQ ID NO: 31502 - DNA, 203 bp, Homo sapiens; identical to SEQ ID NO: 8734
  source 1..203: mol_type = other DNA

SEQ ID NO: 31503 - DNA, 203 bp, Homo sapiens; identical to SEQ ID NO: 8735
  source 1..203: mol_type = other DNA

SEQ ID NO: 31504 - DNA, 203 bp, Homo sapiens; identical to SEQ ID NO: 8736
  source 1..203: mol_type = other DNA

SEQ ID NO: 31505 - DNA, 203 bp, Homo sapiens; identical to SEQ ID NO: 8737
  source 1..203: mol_type = other DNA

SEQ ID NO: 31506 - DNA, 203 bp, Homo sapiens; identical to SEQ ID NO: 8738
  source 1..203: mol_type = other DNA

SEQ ID NO: 31507 - DNA, 203 bp, Homo sapiens; identical to SEQ ID NO: 8739
  source 1..203: mol_type = other DNA

SEQ ID NO: 31508 - DNA, 203 bp, Homo sapiens; identical to SEQ ID NO: 8740
  source 1..203: mol_type = other DNA

SEQ ID NO: 31509 - DNA, 203 bp, Homo sapiens; identical to SEQ ID NO: 8741
  source 1..203: mol_type = other DNA

SEQ ID NO: 31510 - DNA, 203 bp, Homo sapiens; identical to SEQ ID NO: 8742
  source 1..203: mol_type = other DNA

SEQ ID NO: 31511 - DNA, 203 bp, Homo sapiens; identical to SEQ ID NO: 8743
  source 1..203: mol_type = other DNA

SEQ ID NO: 31512 - DNA, 203 bp, Homo sapiens; identical to SEQ ID NO: 8744
  source 1..203: mol_type = other DNA

SEQ ID NO: 31513 - DNA, 203 bp, Homo sapiens; identical to SEQ ID NO: 8745
  source 1..203: mol_type = other DNA

SEQ ID NO: 31514 - DNA, 203 bp, Homo sapiens; identical to SEQ ID NO: 8746
  source 1..203: mol_type = other DNA

SEQ ID NO: 31515 - DNA, 203 bp, Homo sapiens; identical to SEQ ID NO: 8756
  source 1..203: mol_type = other DNA

SEQ ID NO: 31516 - DNA, 203 bp, Homo sapiens; identical to SEQ ID NO: 8757
  source 1..203: mol_type = other DNA

SEQ ID NO: 31517 - DNA, 203 bp, Homo sapiens; identical to SEQ ID NO: 8764
  source 1..203: mol_type = other DNA

SEQ ID NO: 31518 - DNA, 203 bp, Homo sapiens; identical to SEQ ID NO: 8766
  source 1..203: mol_type = other DNA

SEQ ID NO: 31519 - DNA, 203 bp, Homo sapiens; identical to SEQ ID NO: 8775
  source 1..203: mol_type = other DNA

SEQ ID NO: 31520 - DNA, 203 bp, Homo sapiens; identical to SEQ ID NO: 8777
  source 1..203: mol_type = other DNA

SEQ ID NO: 31521 - DNA, 203 bp, Homo sapiens; identical to SEQ ID NO: 8786
  source 1..203: mol_type = other DNA

SEQ ID NO: 31522 - DNA, 203 bp, Homo sapiens; identical to SEQ ID NO: 8788
  source 1..203: mol_type = other DNA

SEQ ID NO: 31523 - DNA, 203 bp, Homo sapiens; identical to SEQ ID NO: 12
  source 1..203: mol_type = other DNA

SEQ ID NO: 31524 - DNA, 203 bp, Homo sapiens; identical to SEQ ID NO: 13
  source 1..203: mol_type = other DNA

SEQ ID NO: 31525 - DNA, 203 bp, Homo sapiens; identical to SEQ ID NO: 23
  source 1..203: mol_type = other DNA

SEQ ID NO: 31526 - DNA, 203 bp, Homo sapiens; identical to SEQ ID NO: 29
  source 1..203: mol_type = other DNA

SEQ ID NO: 31527 - DNA, 203 bp, Homo sapiens; identical to SEQ ID NO: 32
  source 1..203: mol_type = other DNA

SEQ ID NO: 31528 - DNA, 203 bp, Homo sapiens; identical to SEQ ID NO: 35
  source 1..203: mol_type = other DNA

SEQ ID NO: 31529 - DNA, 203 bp, Homo sapiens; identical to SEQ ID NO: 40
  source 1..203: mol_type = other DNA

SEQ ID NO: 31530 - DNA, 203 bp, Homo sapiens; identical to SEQ ID NO: 44
  source 1..203: mol_type = other DNA

SEQ ID NO: 31531 - DNA, 203 bp, Homo sapiens; identical to SEQ ID NO: 45
  source 1..203: mol_type = other DNA

SEQ ID NO: 31532 - DNA, 203 bp, Homo sapiens; identical to SEQ ID NO: 54
  source 1..203: mol_type = other DNA

SEQ ID NO: 31533 - DNA, 203 bp, Homo sapiens; identical to SEQ ID NO: 61
  source 1..203: mol_type = other DNA

SEQ ID NO: 31534 - DNA, 203 bp, Homo sapiens; identical to SEQ ID NO: 62
  source 1..203: mol_type = other DNA

SEQ ID NO: 31535 - DNA, 203 bp, Homo sapiens; identical to SEQ ID NO: 63
  source 1..203: mol_type = other DNA

SEQ ID NO: 31536 - DNA, 203 bp, Homo sapiens; identical to SEQ ID NO: 65
  source 1..203: mol_type = other DNA

SEQ ID NO: 31537 - DNA, 203 bp, Homo sapiens; identical to SEQ ID NO: 66
  source 1..203: mol_type = other DNA

SEQ ID NO: 31538 - DNA, 203 bp, Homo sapiens; identical to SEQ ID NO: 67
  source 1..203: mol_type = other DNA

SEQ ID NO: 31539 - DNA, 203 bp, Homo sapiens; identical to SEQ ID NO: 70
  source 1..203: mol_type = other DNA

SEQ ID NO: 31540 - DNA, 203 bp, Homo sapiens; identical to SEQ ID NO: 72
  source 1..203: mol_type = other DNA

SEQ ID NO: 31541 - DNA, 203 bp, Homo sapiens; identical to SEQ ID NO: 75
  source 1..203: mol_type = other DNA

SEQ ID NO: 31542 - DNA, 203 bp, Homo sapiens; identical to SEQ ID NO: 77
  source 1..203: mol_type = other DNA

SEQ ID NO: 31543 - DNA, 203 bp, Homo sapiens; identical to SEQ ID NO: 83
  source 1..203: mol_type = other DNA

SEQ ID NO: 31544 - DNA, 203 bp, Homo sapiens; identical to SEQ ID NO: 84
  source 1..203: mol_type = other DNA

SEQ ID NO: 31545 - DNA, 203 bp, Homo sapiens; identical to SEQ ID NO: 85
  source 1..203: mol_type = other DNA

SEQ ID NO: 31546 - DNA, 203 bp, Homo sapiens; identical to SEQ ID NO: 87
  source 1..203: mol_type = other DNA

SEQ ID NO: 31547 - DNA, 203 bp, Homo sapiens; identical to SEQ ID NO: 99
  source 1..203: mol_type = other DNA

SEQ ID NO: 31548 - DNA, 203 bp, Homo sapiens; identical to SEQ ID NO: 109
  source 1..203: mol_type = other DNA

SEQ ID NO: 31549 - DNA, 203 bp, Homo sapiens; identical to SEQ ID NO: 110
  source 1..203: mol_type = other DNA

SEQ ID NO: 31550 - DNA, 203 bp, Homo sapiens; identical to SEQ ID NO: 111
  source 1..203: mol_type = other DNA

SEQ ID NO: 31551 - DNA, 203 bp, Homo sapiens; identical to SEQ ID NO: 129
  source 1..203: mol_type = other DNA

SEQ ID NO: 31552 - DNA, 203 bp, Homo sapiens; identical to SEQ ID NO: 139
  source 1..203: mol_type = other DNA

SEQ ID NO: 31553 - DNA, 203 bp, Homo sapiens; identical to SEQ ID NO: 142
  source 1..203: mol_type = other DNA

SEQ ID NO: 31554 - DNA, 203 bp, Homo sapiens; identical to SEQ ID NO: 151
  source 1..203: mol_type = other DNA

SEQ ID NO: 31555 - DNA, 203 bp, Homo sapiens; identical to SEQ ID NO: 166
  source 1..203: mol_type = other DNA

SEQ ID NO: 31556 - DNA, 203 bp, Homo sapiens; identical to SEQ ID NO: 175
  source 1..203: mol_type = other DNA

SEQ ID NO: 31557 - DNA, 203 bp, Homo sapiens; identical to SEQ ID NO: 176
  source 1..203: mol_type = other DNA

SEQ ID NO: 31558 - DNA, 203 bp, Homo sapiens; identical to SEQ ID NO: 177
  source 1..203: mol_type = other DNA

SEQ ID NO: 31559 - DNA, 203 bp, Homo sapiens; identical to SEQ ID NO: 197
  source 1..203: mol_type = other DNA

SEQ ID NO: 31560 - DNA, 203 bp, Homo sapiens; identical to SEQ ID NO: 201
  source 1..203: mol_type = other DNA

SEQ ID NO: 31561 - DNA, 203 bp, Homo sapiens; identical to SEQ ID NO: 207
  source 1..203: mol_type = other DNA

SEQ ID NO: 31562 - DNA, 203 bp, Homo sapiens; identical to SEQ ID NO: 8852
  source 1..203: mol_type = other DNA

SEQ ID NO: 31563 - DNA, 203 bp, Homo sapiens; identical to SEQ ID NO: 8853
  source 1..203: mol_type = other DNA

SEQ ID NO: 31564 - DNA, 203 bp, Homo sapiens; identical to SEQ ID NO: 8855
  source 1..203: mol_type = other DNA

SEQ ID NO: 31565 - DNA, 203 bp, Homo sapiens; identical to SEQ ID NO: 8858
  source 1..203: mol_type = other DNA

SEQ ID NO: 31566 - DNA, 203 bp, Homo sapiens; identical to SEQ ID NO: 8864
  source 1..203: mol_type = other DNA

SEQ ID NO: 31567 - DNA, 203 bp, Homo sapiens; identical to SEQ ID NO: 8865
  source 1..203: mol_type = other DNA

SEQ ID NO: 31568 - DNA, 203 bp, Homo sapiens; identical to SEQ ID NO: 8882
  source 1..203: mol_type = other DNA

SEQ ID NO: 31569 - DNA, 203 bp, Homo sapiens; identical to SEQ ID NO: 8900
  source 1..203: mol_type = other DNA

SEQ ID NO: 31570 - DNA, 203 bp, Homo sapiens; identical to SEQ ID NO: 8920
  source 1..203: mol_type = other DNA

SEQ ID NO: 31571 - DNA, 203 bp, Homo sapiens; identical to SEQ ID NO: 8921
  source 1..203: mol_type = other DNA

SEQ ID NO: 31572 - DNA, 203 bp, Homo sapiens; identical to SEQ ID NO: 8922
  source 1..203: mol_type = other DNA

SEQ ID NO: 31573 - DNA, 203 bp, Homo sapiens; identical to SEQ ID NO: 8924
  source 1..203: mol_type = other DNA

SEQ ID NO: 31574 - DNA, 203 bp, Homo sapiens; identical to SEQ ID NO: 8925
  source 1..203: mol_type = other DNA

SEQ ID NO: 31575 - DNA, 203 bp, Homo sapiens; identical to SEQ ID NO: 8926
  source 1..203: mol_type = other DNA

SEQ ID NO: 31576 - DNA, 203 bp, Homo sapiens; identical to SEQ ID NO: 8927
  source 1..203: mol_type = other DNA

SEQ ID NO: 31577 - DNA, 203 bp, Homo sapiens; identical to SEQ ID NO: 8928
  source 1..203: mol_type = other DNA

SEQ ID NO: 31578 - DNA, 203 bp, Homo sapiens; identical to SEQ ID NO: 8929
  source 1..203: mol_type = other DNA

SEQ ID NO: 31579 - DNA, 203 bp, Homo sapiens; identical to SEQ ID NO: 8930
  source 1..203: mol_type = other DNA

SEQ ID NO: 31580 - DNA, 203 bp, Homo sapiens; identical to SEQ ID NO: 8931
  source 1..203: mol_type = other DNA

SEQ ID NO: 31581 - DNA, 203 bp, Homo sapiens; identical to SEQ ID NO: 8932
  source 1..203: mol_type = other DNA

SEQ ID NO: 31582 - DNA, 203 bp, Homo sapiens; identical to SEQ ID NO: 8936
  source 1..203: mol_type = other DNA

SEQ ID NO: 31583 - DNA, 203 bp, Homo sapiens; identical to SEQ ID NO: 8946
  source 1..203: mol_type = other DNA

SEQ ID NO: 31584 - DNA, 203 bp, Homo sapiens; identical to SEQ ID NO: 8955
  source 1..203: mol_type = other DNA

SEQ ID NO: 31585 - DNA, 203 bp, Homo sapiens; identical to SEQ ID NO: 8971
  source 1..203: mol_type = other DNA

SEQ ID NO: 31586 - DNA, 203 bp, Homo sapiens; identical to SEQ ID NO: 8975
  source 1..203: mol_type = other DNA

SEQ ID NO: 31587 - DNA, 203 bp, Homo sapiens; identical to SEQ ID NO: 8978
  source 1..203: mol_type = other DNA

SEQ ID NO: 31588 - DNA, 203 bp, Homo sapiens; identical to SEQ ID NO: 8979
  source 1..203: mol_type = other DNA

SEQ ID NO: 31589 - DNA, 203 bp, Homo sapiens; identical to SEQ ID NO: 8982
  source 1..203: mol_type = other DNA

SEQ ID NO: 31590 - DNA, 203 bp, Homo sapiens; identical to SEQ ID NO: 8983
  source 1..203: mol_type = other DNA

SEQ ID NO: 31591 - DNA, 203 bp, Homo sapiens; identical to SEQ ID NO: 8984
  source 1..203: mol_type = other DNA

SEQ ID NO: 31592 - DNA, 203 bp, Homo sapiens; identical to SEQ ID NO: 8985
  source 1..203: mol_type = other DNA

SEQ ID NO: 31593 - DNA, 203 bp, Homo sapiens; identical to SEQ ID NO: 8987
  source 1..203: mol_type = other DNA

SEQ ID NO: 31594 - DNA, 203 bp, Homo sapiens; identical to SEQ ID NO: 8992
  source 1..203: mol_type = other DNA

SEQ ID NO: 31595 - DNA, 203 bp, Homo sapiens; identical to SEQ ID NO: 8994
  source 1..203: mol_type = other DNA

SEQ ID NO: 31596 - DNA, 203 bp, Homo sapiens; identical to SEQ ID NO: 8995
  source 1..203: mol_type = other DNA

SEQ ID NO: 31597 - DNA, 203 bp, Homo sapiens; identical to SEQ ID NO: 8996
  source 1..203: mol_type = other DNA

SEQ ID NO: 31598 - DNA, 203 bp, Homo sapiens; identical to SEQ ID NO: 8997
  source 1..203: mol_type = other DNA

SEQ ID NO: 31599 - DNA, 203 bp, Homo sapiens; identical to SEQ ID NO: 8998
  source 1..203: mol_type = other DNA

SEQ ID NO: 31600 - DNA, 203 bp, Homo sapiens; identical to SEQ ID NO: 8999
  source 1..203: mol_type = other DNA

SEQ ID NO: 31601 - DNA, 203 bp, Homo sapiens; identical to SEQ ID NO: 9001
  source 1..203: mol_type = other DNA

SEQ ID NO: 31602 - DNA, 203 bp, Homo sapiens; identical to SEQ ID NO: 9004
  source 1..203: mol_type = other DNA

SEQ ID NO: 31603 - DNA, 203 bp, Homo sapiens; identical to SEQ ID NO: 9008
  source 1..203: mol_type = other DNA

SEQ ID NO: 31604 - DNA, 203 bp, Homo sapiens; identical to SEQ ID NO: 9011
  source 1..203: mol_type = other DNA

SEQ ID NO: 31605 - DNA, 203 bp, Homo sapiens; identical to SEQ ID NO: 9012
  source 1..203: mol_type = other DNA

SEQ ID NO: 31606 - DNA, 203 bp, Homo sapiens; identical to SEQ ID NO: 9015
  source 1..203: mol_type = other DNA

SEQ ID NO: 31607 - DNA, 203 bp, Homo sapiens; identical to SEQ ID NO: 9017
  source 1..203: mol_type = other DNA

SEQ ID NO: 31608 - DNA, 203 bp, Homo sapiens; identical to SEQ ID NO: 9019
  source 1..203: mol_type = other DNA

SEQ ID NO: 31609 - DNA, 203 bp, Homo sapiens; identical to SEQ ID NO: 9026
  source 1..203: mol_type = other DNA

SEQ ID NO: 31610 - DNA, 203 bp, Homo sapiens; identical to SEQ ID NO: 9029
  source 1..203: mol_type = other DNA

SEQ ID NO: 31611 - DNA, 203 bp, Homo sapiens; identical to SEQ ID NO: 9031
  source 1..203: mol_type = other DNA

SEQ ID NO: 31612 - DNA, 203 bp, Homo sapiens; identical to SEQ ID NO: 9032
  source 1..203: mol_type = other DNA

SEQ ID NO: 31613 - DNA, 203 bp, Homo sapiens; identical to SEQ ID NO: 9033
  source 1..203: mol_type = other DNA

SEQ ID NO: 31614 - DNA, 203 bp, Homo sapiens; identical to SEQ ID NO: 9034
  source 1..203: mol_type = other DNA

SEQ ID NO: 31615 - DNA, 203 bp, Homo sapiens; identical to SEQ ID NO: 9035
  source 1..203: mol_type = other DNA

SEQ ID NO: 31616 - DNA, 203 bp, Homo sapiens; identical to SEQ ID NO: 9036
  source 1..203: mol_type = other DNA

SEQ ID NO: 31617 - DNA, 203 bp, Homo sapiens; identical to SEQ ID NO: 9042
  source 1..203: mol_type = other DNA

SEQ ID NO: 31618 - DNA, 203 bp, Homo sapiens; identical to SEQ ID NO: 9045
  source 1..203: mol_type = other DNA

SEQ ID NO: 31619 - DNA, 203 bp, Homo sapiens; identical to SEQ ID NO: 9049
  source 1..203: mol_type = other DNA

SEQ ID NO: 31620 - DNA, 203 bp, Homo sapiens; identical to SEQ ID NO: 9051
  source 1..203: mol_type = other DNA

SEQ ID NO: 31621 - DNA, 203 bp, Homo sapiens; identical to SEQ ID NO: 9053
  source 1..203: mol_type = other DNA

SEQ ID NO: 31622 - DNA, 203 bp, Homo sapiens; identical to SEQ ID NO: 9054
  source 1..203: mol_type = other DNA

SEQ ID NO: 31623 - DNA, 203 bp, Homo sapiens; identical to SEQ ID NO: 9055
  source 1..203: mol_type = other DNA

SEQ ID NO: 31624 - DNA, 203 bp, Homo sapiens; identical to SEQ ID NO: 9059
  source 1..203: mol_type = other DNA

SEQ ID NO: 31625 - DNA, 203 bp, Homo sapiens; identical to SEQ ID NO: 9061
  source 1..203: mol_type = other DNA

SEQ ID NO: 31626 - DNA, 203 bp, Homo sapiens; identical to SEQ ID NO: 9063
  source 1..203: mol_type = other DNA

SEQ ID NO: 31627 - DNA, 203 bp, Homo sapiens; identical to SEQ ID NO: 9068
  source 1..203: mol_type = other DNA

SEQ ID NO: 31628 - DNA, 203 bp, Homo sapiens; identical to SEQ ID NO: 9072
  source 1..203: mol_type = other DNA

SEQ ID NO: 31629 - DNA, 203 bp, Homo sapiens; identical to SEQ ID NO: 9079
  source 1..203: mol_type = other DNA

SEQ ID NO: 31630 - DNA, 203 bp, Homo sapiens; identical to SEQ ID NO: 9080
  source 1..203: mol_type = other DNA

SEQ ID NO: 31631 - DNA, 203 bp, Homo sapiens; identical to SEQ ID NO: 9082
  source 1..203: mol_type = other DNA

SEQ ID NO: 31632 - DNA, 203 bp, Homo sapiens; identical to SEQ ID NO: 9084
  source 1..203: mol_type = other DNA

SEQ ID NO: 31633 - DNA, 203 bp, Homo sapiens; identical to SEQ ID NO: 9088
  source 1..203: mol_type = other DNA

SEQ ID NO: 31634 - DNA, 203 bp, Homo sapiens; identical to SEQ ID NO: 9089
  source 1..203: mol_type = other DNA

SEQ ID NO: 31635 - DNA, 203 bp, Homo sapiens; identical to SEQ ID NO: 9092
  source 1..203: mol_type = other DNA

SEQ ID NO: 31636 - DNA, 203 bp, Homo sapiens; identical to SEQ ID NO: 9095
  source 1..203: mol_type = other DNA

SEQ ID NO: 31637 - DNA, 203 bp, Homo sapiens; identical to SEQ ID NO: 9096
  source 1..203: mol_type = other DNA

SEQ ID NO: 31638 - DNA, 203 bp, Homo sapiens; identical to SEQ ID NO: 9103
  source 1..203: mol_type = other DNA

SEQ ID NO: 31639 - DNA, 203 bp, Homo sapiens; identical to SEQ ID NO: 9104
  source 1..203: mol_type = other DNA

SEQ ID NO: 31640 - DNA, 203 bp, Homo sapiens; identical to SEQ ID NO: 9109
  source 1..203: mol_type = other DNA

SEQ ID NO: 31641 - DNA, 203 bp, Homo sapiens; identical to SEQ ID NO: 9111
  source 1..203: mol_type = other DNA

SEQ ID NO: 31642 - DNA, 203 bp, Homo sapiens; identical to SEQ ID NO: 9112
  source 1..203: mol_type = other DNA

SEQ ID NO: 31643 - DNA, 203 bp, Homo sapiens; identical to SEQ ID NO: 9113
  source 1..203: mol_type = other DNA

SEQ ID NO: 31644 - DNA, 203 bp, Homo sapiens; identical to SEQ ID NO: 9116
  source 1..203: mol_type = other DNA

SEQ ID NO: 31645 - DNA, 203 bp, Homo sapiens; identical to SEQ ID NO: 9117
  source 1..203: mol_type = other DNA

SEQ ID NO: 31646 - DNA, 203 bp, Homo sapiens; identical to SEQ ID NO: 9119
  source 1..203: mol_type = other DNA

SEQ ID NO: 31647 - DNA, 203 bp, Homo sapiens; identical to SEQ ID NO: 9122
  source 1..203: mol_type = other DNA

SEQ ID NO: 31648 - DNA, 203 bp, Homo sapiens; identical to SEQ ID NO: 9127
  source 1..203: mol_type = other DNA

SEQ ID NO: 31649 - DNA, 203 bp, Homo sapiens; identical to SEQ ID NO: 9132
  source 1..203: mol_type = other DNA

SEQ ID NO: 31650 - DNA, 203 bp, Homo sapiens; identical to SEQ ID NO: 9134
  source 1..203: mol_type = other DNA

SEQ ID NO: 31651 - DNA, 203 bp, Homo sapiens; identical to SEQ ID NO: 9136
  source 1..203: mol_type = other DNA

SEQ ID NO: 31652 - DNA, 203 bp, Homo sapiens; identical to SEQ ID NO: 9139
  source 1..203: mol_type = other DNA

SEQ ID NO: 31653 - DNA, 203 bp, Homo sapiens; identical to SEQ ID NO: 9142
  source 1..203: mol_type = other DNA

SEQ ID NO: 31654 - DNA, 203 bp, Homo sapiens; identical to SEQ ID NO: 9149
  source 1..203: mol_type = other DNA

SEQ ID NO: 31655 - DNA, 203 bp, Homo sapiens; identical to SEQ ID NO: 9155
  source 1..203: mol_type = other DNA

SEQ ID NO: 31656 - DNA, 203 bp, Homo sapiens; identical to SEQ ID NO: 9156
  source 1..203: mol_type = other DNA

SEQ ID NO: 31657 - DNA, 203 bp, Homo sapiens; identical to SEQ ID NO: 9157
  source 1..203: mol_type = other DNA

SEQ ID NO: 31658 - DNA, 203 bp, Homo sapiens; identical to SEQ ID NO: 9168
  source 1..203: mol_type = other DNA

SEQ ID NO: 31659 - DNA, 203 bp, Homo sapiens; identical to SEQ ID NO: 9174
  source 1..203: mol_type = other DNA

SEQ ID NO: 31660 - DNA, 203 bp, Homo sapiens; identical to SEQ ID NO: 9176
  source 1..203: mol_type = other DNA

SEQ ID NO: 31661 - DNA, 203 bp, Homo sapiens; identical to SEQ ID NO: 9177
  source 1..203: mol_type = other DNA

SEQ ID NO: 31662 - DNA, 203 bp, Homo sapiens; identical to SEQ ID NO: 9178
  source 1..203: mol_type = other DNA

SEQ ID NO: 31663 - DNA, 203 bp, Homo sapiens; identical to SEQ ID NO: 9181
  source 1..203: mol_type = other DNA

SEQ ID NO: 31664 - DNA, 203 bp, Homo sapiens; identical to SEQ ID NO: 9182
  source 1..203: mol_type = other DNA

SEQ ID NO: 31665 - DNA, 203 bp, Homo sapiens; identical to SEQ ID NO: 9185
  source 1..203: mol_type = other DNA

SEQ ID NO: 31666 - DNA, 203 bp, Homo sapiens; identical to SEQ ID NO: 9186
  source 1..203: mol_type = other DNA

SEQ ID NO: 31667 - DNA, 203 bp, Homo sapiens; identical to SEQ ID NO: 9188
  source 1..203: mol_type = other DNA

SEQ ID NO: 31668 - DNA, 203 bp, Homo sapiens; identical to SEQ ID NO: 9190
  source 1..203: mol_type = other DNA

SEQ ID NO: 31669 - DNA, 203 bp, Homo sapiens; identical to SEQ ID NO: 9191
  source 1..203: mol_type = other DNA

SEQ ID NO: 31670 - DNA, 203 bp, Homo sapiens; identical to SEQ ID NO: 9195
  source 1..203: mol_type = other DNA

SEQ ID NO: 31671 - DNA, 203 bp, Homo sapiens; identical to SEQ ID NO: 9198
  source 1..203: mol_type = other DNA

SEQ ID NO: 31672 - DNA, 203 bp, Homo sapiens; identical to SEQ ID NO: 9211
  source 1..203: mol_type = other DNA

SEQ ID NO: 31673 - DNA, 203 bp, Homo sapiens; identical to SEQ ID NO: 9221
  source 1..203: mol_type = other DNA

SEQ ID NO: 31674 - DNA, 203 bp, Homo sapiens; identical to SEQ ID NO: 9225
  source 1..203: mol_type = other DNA

SEQ ID NO: 31675 - DNA, 203 bp, Homo sapiens; identical to SEQ ID NO: 9229
  source 1..203: mol_type = other DNA

SEQ ID NO: 31676 - DNA, 203 bp, Homo sapiens; identical to SEQ ID NO: 9232
  source 1..203: mol_type = other DNA

SEQ ID NO: 31677 - DNA, 203 bp, Homo sapiens; identical to SEQ ID NO: 9235
  source 1..203: mol_type = other DNA

SEQ ID NO: 31678 - DNA, 203 bp, Homo sapiens; identical to SEQ ID NO: 9242
  source 1..203: mol_type = other DNA

SEQ ID NO: 31679 - DNA, 203 bp, Homo sapiens; identical to SEQ ID NO: 9244
  source 1..203: mol_type = other DNA

SEQ ID NO: 31680 - DNA, 203 bp, Homo sapiens; identical to SEQ ID NO: 9246
  source 1..203: mol_type = other DNA

SEQ ID NO: 31681 - DNA, 203 bp, Homo sapiens; identical to SEQ ID NO: 9252
  source 1..203: mol_type = other DNA

SEQ ID NO: 31682 - DNA, 203 bp, Homo sapiens; identical to SEQ ID NO: 9254
  source 1..203: mol_type = other DNA

SEQ ID NO: 31683 - DNA, 203 bp, Homo sapiens; identical to SEQ ID NO: 9255
  source 1..203: mol_type = other DNA

SEQ ID NO: 31684 - DNA, 203 bp, Homo sapiens; identical to SEQ ID NO: 9257
  source 1..203: mol_type = other DNA

SEQ ID NO: 31685 - DNA, 203 bp, Homo sapiens; identical to SEQ ID NO: 9259
  source 1..203: mol_type = other DNA

SEQ ID NO: 31686 - DNA, 203 bp, Homo sapiens; identical to SEQ ID NO: 9262
  source 1..203: mol_type = other DNA

SEQ ID NO: 31687 - DNA, 203 bp, Homo sapiens; identical to SEQ ID NO: 9264
  source 1..203: mol_type = other DNA

SEQ ID NO: 31688 - DNA, 203 bp, Homo sapiens; identical to SEQ ID NO: 9265
  source 1..203: mol_type = other DNA

SEQ ID NO: 31689 - DNA, 203 bp, Homo sapiens; identical to SEQ ID NO: 9266
  source 1..203: mol_type = other DNA

SEQ ID NO: 31690 - DNA, 203 bp, Homo sapiens; identical to SEQ ID NO: 9271
  source 1..203: mol_type = other DNA

SEQ ID NO: 31691 - DNA, 203 bp, Homo sapiens; identical to SEQ ID NO: 9272
  source 1..203: mol_type = other DNA

SEQ ID NO: 31692 - DNA, 203 bp, Homo sapiens; identical to SEQ ID NO: 9274
  source 1..203: mol_type = other DNA

SEQ ID NO: 31693 - DNA, 203 bp, Homo sapiens; identical to SEQ ID NO: 9276
  source 1..203: mol_type = other DNA

SEQ ID NO: 31694 - DNA, 203 bp, Homo sapiens; identical to SEQ ID NO: 9283
  source 1..203: mol_type = other DNA

SEQ ID NO: 31695 - DNA, 203 bp, Homo sapiens; identical to SEQ ID NO: 9284
  source 1..203: mol_type = other DNA

SEQ ID NO: 31696 - DNA, 203 bp, Homo sapiens; identical to SEQ ID NO: 9288
  source 1..203: mol_type = other DNA

SEQ ID NO: 31697 - DNA, 203 bp, Homo sapiens; identical to SEQ ID NO: 9289
  source 1..203: mol_type = other DNA

SEQ ID NO: 31698 - DNA, 203 bp, Homo sapiens; identical to SEQ ID NO: 9291
  source 1..203: mol_type = other DNA

SEQ ID NO: 31699 - DNA, 203 bp, Homo sapiens; identical to SEQ ID NO: 9294
  source 1..203: mol_type = other DNA

SEQ ID NO: 31700 - DNA, 203 bp, Homo sapiens; identical to SEQ ID NO: 9296
  source 1..203: mol_type = other DNA

SEQ ID NO: 31701 - DNA, 203 bp, Homo sapiens; identical to SEQ ID NO: 9298
  source 1..203: mol_type = other DNA

SEQ ID NO: 31702 - DNA, 203 bp, Homo sapiens; identical to SEQ ID NO: 9300
  source 1..203: mol_type = other DNA

SEQ ID NO: 31703 - DNA, 203 bp, Homo sapiens; identical to SEQ ID NO: 9302
  source 1..203: mol_type = other DNA

SEQ ID NO: 31704 - DNA, 203 bp, Homo sapiens; identical to SEQ ID NO: 9306
  source 1..203: mol_type = other DNA

SEQ ID NO: 31705 - DNA, 203 bp, Homo sapiens; identical to SEQ ID NO: 9308
  source 1..203: mol_type = other DNA

SEQ ID NO: 31706 - DNA, 203 bp, Homo sapiens; identical to SEQ ID NO: 9309
  source 1..203: mol_type = other DNA

SEQ ID NO: 31707 - DNA, 203 bp, Homo sapiens; identical to SEQ ID NO: 9313
  source 1..203: mol_type = other DNA

SEQ ID NO: 31708 - DNA, 203 bp, Homo sapiens; identical to SEQ ID NO: 9319
  source 1..203: mol_type = other DNA

SEQ ID NO: 31709 - DNA, 203 bp, Homo sapiens; identical to SEQ ID NO: 9320
  source 1..203: mol_type = other DNA

SEQ ID NO: 31710 - DNA, 203 bp, Homo sapiens; identical to SEQ ID NO: 9322
  source 1..203: mol_type = other DNA

SEQ ID NO: 31711 - DNA, 203 bp, Homo sapiens; identical to SEQ ID NO: 9324
  source 1..203: mol_type = other DNA

SEQ ID NO: 31712 - DNA, 203 bp, Homo sapiens; identical to SEQ ID NO: 9335
  source 1..203: mol_type = other DNA

SEQ ID NO: 31713 - DNA, 203 bp, Homo sapiens; identical to SEQ ID NO: 9343
  source 1..203: mol_type = other DNA

SEQ ID NO: 31714 - DNA, 203 bp, Homo sapiens; identical to SEQ ID NO: 9347
  source 1..203: mol_type = other DNA

SEQ ID NO: 31715 - DNA, 203 bp, Homo sapiens; identical to SEQ ID NO: 9348
  source 1..203: mol_type = other DNA

SEQ ID NO: 31716 - DNA, 203 bp, Homo sapiens; identical to SEQ ID NO: 9353
  source 1..203: mol_type = other DNA

SEQ ID NO: 31717 - DNA, 203 bp, Homo sapiens; identical to SEQ ID NO: 9354
  source 1..203: mol_type = other DNA

SEQ ID NO: 31718 - DNA, 203 bp, Homo sapiens; identical to SEQ ID NO: 9358
  source 1..203: mol_type = other DNA

SEQ ID NO: 31719 - DNA, 203 bp, Homo sapiens; identical to SEQ ID NO: 9373
  source 1..203: mol_type = other DNA

SEQ ID NO: 31720 - DNA, 203 bp, Homo sapiens; identical to SEQ ID NO: 9377
  source 1..203: mol_type = other DNA

SEQ ID NO: 31721 - DNA, 203 bp, Homo sapiens; identical to SEQ ID NO: 9378
  source 1..203: mol_type = other DNA

SEQ ID NO: 31722 - DNA, 203 bp, Homo sapiens; identical to SEQ ID NO: 9379
  source 1..203: mol_type = other DNA

SEQ ID NO: 31723 - DNA, 203 bp, Homo sapiens; identical to SEQ ID NO: 9380
  source 1..203: mol_type = other DNA

SEQ ID NO: 31724 - DNA, 203 bp, Homo sapiens; identical to SEQ ID NO: 9381
  source 1..203: mol_type = other DNA

SEQ ID NO: 31725 - DNA, 203 bp, Homo sapiens; identical to SEQ ID NO: 9384
  source 1..203: mol_type = other DNA

SEQ ID NO: 31726 - DNA, 203 bp, Homo sapiens; identical to SEQ ID NO: 9391
  source 1..203: mol_type = other DNA

SEQ ID NO: 31727 - DNA, 203 bp, Homo sapiens; identical to SEQ ID NO: 9392
  source 1..203: mol_type = other DNA

SEQ ID NO: 31728 - DNA, 203 bp, Homo sapiens; identical to SEQ ID NO: 9397
  source 1..203: mol_type = other DNA

SEQ ID NO: 31729 - DNA, 203 bp, Homo sapiens; identical to SEQ ID NO: 9398
  source 1..203: mol_type = other DNA

SEQ ID NO: 31730 - DNA, 203 bp, Homo sapiens; identical to SEQ ID NO: 9400
  source 1..203: mol_type = other DNA

SEQ ID NO: 31731 - DNA, 203 bp, Homo sapiens; identical to SEQ ID NO: 9404
  source 1..203: mol_type = other DNA

SEQ ID NO: 31732 - DNA, 203 bp, Homo sapiens; identical to SEQ ID NO: 9406
  source 1..203: mol_type = other DNA

SEQ ID NO: 31733 - DNA, 203 bp, Homo sapiens; identical to SEQ ID NO: 9416
  source 1..203: mol_type = other DNA

SEQ ID NO: 31734 - DNA, 203 bp, Homo sapiens; identical to SEQ ID NO: 9423
  source 1..203: mol_type = other DNA

SEQ ID NO: 31735 - DNA, 203 bp, Homo sapiens; identical to SEQ ID NO: 9425
  source 1..203: mol_type = other DNA

SEQ ID NO: 31736 - DNA, 203 bp, Homo sapiens; identical to SEQ ID NO: 9442
  source 1..203: mol_type = other DNA

SEQ ID NO: 31737 - DNA, 203 bp, Homo sapiens; identical to SEQ ID NO: 9444
  source 1..203: mol_type = other DNA

SEQ ID NO: 31738 - DNA, 203 bp, Homo sapiens; identical to SEQ ID NO: 9445
  source 1..203: mol_type = other DNA

SEQ ID NO: 31739 - DNA, 203 bp, Homo sapiens; identical to SEQ ID NO: 9501
  source 1..203: mol_type = other DNA

SEQ ID NO: 31740 - DNA, 203 bp, Homo sapiens; identical to SEQ ID NO: 9502
  source 1..203: mol_type = other DNA

SEQ ID NO: 31741 - DNA, 203 bp, Homo sapiens; identical to SEQ ID NO: 9503
  source 1..203: mol_type = other DNA

SEQ ID NO: 31742 - DNA, 203 bp, Homo sapiens; identical to SEQ ID NO: 9504
  source 1..203: mol_type = other DNA

SEQ ID NO: 31743 - DNA, 203 bp, Homo sapiens; identical to SEQ ID NO: 9510
  source 1..203: mol_type = other DNA

SEQ ID NO: 31744 - DNA, 203 bp, Homo sapiens; identical to SEQ ID NO: 9511
  source 1..203: mol_type = other DNA

SEQ ID NO: 31745 - DNA, 203 bp, Homo sapiens; identical to SEQ ID NO: 9512
  source 1..203: mol_type = other DNA

SEQ ID NO: 31746 - DNA, 203 bp, Homo sapiens; identical to SEQ ID NO: 9522
  source 1..203: mol_type = other DNA

SEQ ID NO: 31747 - DNA, 203 bp, Homo sapiens; identical to SEQ ID NO: 9536
  source 1..203: mol_type = other DNA

SEQ ID NO: 31748 - DNA, 203 bp, Homo sapiens; identical to SEQ ID NO: 9537
  source 1..203: mol_type = other DNA

SEQ ID NO: 31749 - DNA, 203 bp, Homo sapiens; identical to SEQ ID NO: 9538
  source 1..203: mol_type = other DNA

SEQ ID NO: 31750 - DNA, 203 bp, Homo sapiens; identical to SEQ ID NO: 9539
  source 1..203: mol_type = other DNA

SEQ ID NO: 31751 - DNA, 203 bp, Homo sapiens; identical to SEQ ID NO: 9550
  source 1..203: mol_type = other DNA

SEQ ID NO: 31752 - DNA, 203 bp, Homo sapiens; identical to SEQ ID NO: 9551
  source 1..203: mol_type = other DNA

SEQ ID NO: 31753 - DNA, 203 bp, Homo sapiens; identical to SEQ ID NO: 9552
  source 1..203: mol_type = other DNA

SEQ ID NO: 31754 - DNA, 203 bp, Homo sapiens; identical to SEQ ID NO: 9569
  source 1..203: mol_type = other DNA

SEQ ID NO: 31755 - DNA, 203 bp, Homo sapiens; identical to SEQ ID NO: 9570
  source 1..203: mol_type = other DNA

SEQ ID NO: 31756 - DNA, 203 bp, Homo sapiens; identical to SEQ ID NO: 9571
  source 1..203: mol_type = other DNA

SEQ ID NO: 31757 - DNA, 203 bp, Homo sapiens; identical to SEQ ID NO: 9572
  source 1..203: mol_type = other DNA

SEQ ID NO: 31758 - DNA, 203 bp, Homo sapiens; identical to SEQ ID NO: 9573
  source 1..203: mol_type = other DNA

SEQ ID NO: 31759 - DNA, 203 bp, Homo sapiens; identical to SEQ ID NO: 9574
  source 1..203: mol_type = other DNA

SEQ ID NO: 31760 - DNA, 203 bp, Homo sapiens; identical to SEQ ID NO: 9575
  source 1..203: mol_type = other DNA

SEQ ID NO: 31761 - DNA, 203 bp, Homo sapiens; identical to SEQ ID NO: 9576
  source 1..203: mol_type = other DNA

SEQ ID NO: 31762 - DNA, 203 bp, Homo sapiens; identical to SEQ ID NO: 9577
  source 1..203: mol_type = other DNA

SEQ ID NO: 31763 - DNA, 203 bp, Homo sapiens; identical to SEQ ID NO: 9578
  source 1..203: mol_type = other DNA

SEQ ID NO: 31764 - DNA, 203 bp, Homo sapiens; identical to SEQ ID NO: 9579
  source 1..203: mol_type = other DNA

SEQ ID NO: 31765 - DNA, 203 bp, Homo sapiens; identical to SEQ ID NO: 9581
  source 1..203: mol_type = other DNA

SEQ ID NO: 31766 - DNA, 203 bp, Homo sapiens; identical to SEQ ID NO: 9582
  source 1..203: mol_type = other DNA

SEQ ID NO: 31767 - DNA, 203 bp, Homo sapiens; identical to SEQ ID NO: 9583
  source 1..203: mol_type = other DNA

SEQ ID NO: 31768 - DNA, 203 bp, Homo sapiens; identical to SEQ ID NO: 9584
  source 1..203: mol_type = other DNA

SEQ ID NO: 31769 - DNA, 203 bp, Homo sapiens; identical to SEQ ID NO: 9585
  source 1..203: mol_type = other DNA

SEQ ID NO: 31770 - DNA, 203 bp, Homo sapiens; identical to SEQ ID NO: 9586
  source 1..203: mol_type = other DNA

SEQ ID NO: 31771 - DNA, 203 bp, Homo sapiens; identical to SEQ ID NO: 9587
  source 1..203: mol_type = other DNA

SEQ ID NO: 31772 - DNA, 203 bp, Homo sapiens; identical to SEQ ID NO: 9588
  source 1..203: mol_type = other DNA

SEQ ID NO: 31773 - DNA, 203 bp, Homo sapiens; identical to SEQ ID NO: 9600
  source 1..203: mol_type = other DNA

SEQ ID NO: 31774 - DNA, 203 bp, Homo sapiens; identical to SEQ ID NO: 9601
  source 1..203: mol_type = other DNA

SEQ ID NO: 31775 - DNA, 203 bp, Homo sapiens; identical to SEQ ID NO: 9607
  source 1..203: mol_type = other DNA

SEQ ID NO: 31776 - DNA, 203 bp, Homo sapiens; identical to SEQ ID NO: 9608
  source 1..203: mol_type = other DNA

SEQ ID NO: 31777 - DNA, 203 bp, Homo sapiens; identical to SEQ ID NO: 9609
  source 1..203: mol_type = other DNA

SEQ ID NO: 31778 - DNA, 203 bp, Homo sapiens; identical to SEQ ID NO: 9610
  source 1..203: mol_type = other DNA

SEQ ID NO: 31779 - DNA, 203 bp, Homo sapiens; identical to SEQ ID NO: 9611
  source 1..203: mol_type = other DNA

SEQ ID NO: 31780 - DNA, 203 bp, Homo sapiens; identical to SEQ ID NO: 9616
  source 1..203: mol_type = other DNA

SEQ ID NO: 31781 - DNA, 203 bp, Homo sapiens; identical to SEQ ID NO: 9622
  source 1..203: mol_type = other DNA

SEQ ID NO: 31782 - DNA, 203 bp, Homo sapiens; identical to SEQ ID NO: 9629
  source 1..203: mol_type = other DNA

SEQ ID NO: 31783 - DNA, 203 bp, Homo sapiens; identical to SEQ ID NO: 9632
  source 1..203: mol_type = other DNA

SEQ ID NO: 31784 - DNA, 203 bp, Homo sapiens; identical to SEQ ID NO: 9636
  source 1..203: mol_type = other DNA

SEQ ID NO: 31785 - DNA, 203 bp, Homo sapiens; identical to SEQ ID NO: 9637
  source 1..203: mol_type = other DNA

SEQ ID NO: 31786 - DNA, 203 bp, Homo sapiens; identical to SEQ ID NO: 9639
  source 1..203: mol_type = other DNA

SEQ ID NO: 31787 - DNA, 203 bp, Homo sapiens; identical to SEQ ID NO: 9641
  source 1..203: mol_type = other DNA

SEQ ID NO: 31788 - DNA, 203 bp, Homo sapiens; identical to SEQ ID NO: 9642
  source 1..203: mol_type = other DNA

SEQ ID NO: 31789 - DNA, 203 bp, Homo sapiens; identical to SEQ ID NO: 9647
  source 1..203: mol_type = other DNA

SEQ ID NO: 31790 - DNA, 203 bp, Homo sapiens; identical to SEQ ID NO: 9649
  source 1..203: mol_type = other DNA

SEQ ID NO: 31791 - DNA, 203 bp, Homo sapiens; identical to SEQ ID NO: 9655
  source 1..203: mol_type = other DNA

SEQ ID NO: 31792 - DNA, 203 bp, Homo sapiens; identical to SEQ ID NO: 9657
  source 1..203: mol_type = other DNA

SEQ ID NO: 31793 - DNA, 203 bp, Homo sapiens; identical to SEQ ID NO: 9658
  source 1..203: mol_type = other DNA

SEQ ID NO: 31794 - DNA, 203 bp, Homo sapiens; identical to SEQ ID NO: 9664
  source 1..203: mol_type = other DNA

SEQ ID NO: 31795 - DNA, 203 bp, Homo sapiens; identical to SEQ ID NO: 9665
  source 1..203: mol_type = other DNA

SEQ ID NO: 31796 - DNA, 203 bp, Homo sapiens; identical to SEQ ID NO: 9671
  source 1..203: mol_type = other DNA

SEQ ID NO: 31797 - DNA, 203 bp, Homo sapiens; identical to SEQ ID NO: 9678
  source 1..203: mol_type = other DNA

SEQ ID NO: 31798 - DNA, 203 bp, Homo sapiens; identical to SEQ ID NO: 9682
  source 1..203: mol_type = other DNA

SEQ ID NO: 31799 - DNA, 203 bp, Homo sapiens; identical to SEQ ID NO: 9683
  source 1..203: mol_type = other DNA

SEQ ID NO: 31800 - DNA, 203 bp, Homo sapiens; identical to SEQ ID NO: 9685
  source 1..203: mol_type = other DNA

SEQ ID NO: 31801 - DNA, 203 bp, Homo sapiens; identical to SEQ ID NO: 9687
  source 1..203: mol_type = other DNA

SEQ ID NO: 31802 - DNA, 203 bp, Homo sapiens; identical to SEQ ID NO: 9689
  source 1..203: mol_type = other DNA

SEQ ID NO: 31803 - DNA, 203 bp, Homo sapiens; identical to SEQ ID NO: 9692
  source 1..203: mol_type = other DNA

SEQ ID NO: 31804 - DNA, 203 bp, Homo sapiens; identical to SEQ ID NO: 9695
  source 1..203: mol_type = other DNA

SEQ ID NO: 31805 - DNA, 203 bp, Homo sapiens; identical to SEQ ID NO: 9697
  source 1..203: mol_type = other DNA

SEQ ID NO: 31806 - DNA, 203 bp, Homo sapiens; identical to SEQ ID NO: 9700
  source 1..203: mol_type = other DNA

SEQ ID NO: 31807 - DNA, 203 bp, Homo sapiens; identical to SEQ ID NO: 9707
  source 1..203: mol_type = other DNA

SEQ ID NO: 31808 - DNA, 203 bp, Homo sapiens; identical to SEQ ID NO: 9708
  source 1..203: mol_type = other DNA

SEQ ID NO: 31809 - DNA, 203 bp, Homo sapiens; identical to SEQ ID NO: 9709
  source 1..203: mol_type = other DNA

SEQ ID NO: 31810 - DNA, 203 bp, Homo sapiens; identical to SEQ ID NO: 9713
  source 1..203: mol_type = other DNA

SEQ ID NO: 31811 - DNA, 203 bp, Homo sapiens; identical to SEQ ID NO: 9718
  source 1..203: mol_type = other DNA

SEQ ID NO: 31812 - DNA, 203 bp, Homo sapiens; identical to SEQ ID NO: 9719
  source 1..203: mol_type = other DNA

SEQ ID NO: 31813 - DNA, 203 bp, Homo sapiens; identical to SEQ ID NO: 9720
  source 1..203: mol_type = other DNA

SEQ ID NO: 31814 - DNA, 203 bp, Homo sapiens; identical to SEQ ID NO: 9722
  source 1..203: mol_type = other DNA

SEQ ID NO: 31815 - DNA, 203 bp, Homo sapiens; identical to SEQ ID NO: 9726
  source 1..203: mol_type = other DNA

SEQ ID NO: 31816 - DNA, 203 bp, Homo sapiens; identical to SEQ ID NO: 9728
  source 1..203: mol_type = other DNA

SEQ ID NO: 31817 - DNA, 203 bp, Homo sapiens; identical to SEQ ID NO: 9730
  source 1..203: mol_type = other DNA

SEQ ID NO: 31818 - DNA, 203 bp, Homo sapiens; identical to SEQ ID NO: 9734
  source 1..203: mol_type = other DNA

SEQ ID NO: 31819 - DNA, 203 bp, Homo sapiens; identical to SEQ ID NO: 9741
  source 1..203: mol_type = other DNA

SEQ ID NO: 31820 - DNA, 203 bp, Homo sapiens; identical to SEQ ID NO: 9742
  source 1..203: mol_type = other DNA

SEQ ID NO: 31821 - DNA, 203 bp, Homo sapiens; identical to SEQ ID NO: 9744
  source 1..203: mol_type = other DNA

SEQ ID NO: 31822 - DNA, 203 bp, Homo sapiens; identical to SEQ ID NO: 9751
  source 1..203: mol_type = other DNA

SEQ ID NO: 31823 - DNA, 203 bp, Homo sapiens; identical to SEQ ID NO: 9759
  source 1..203: mol_type = other DNA

SEQ ID NO: 31824 - DNA, 203 bp, Homo sapiens; identical to SEQ ID NO: 9760
  source 1..203: mol_type = other DNA

SEQ ID NO: 31825 - DNA, 203 bp, Homo sapiens; identical to SEQ ID NO: 9766
  source 1..203: mol_type = other DNA

SEQ ID NO: 31826 - DNA, 203 bp, Homo sapiens; identical to SEQ ID NO: 9770
  source 1..203: mol_type = other DNA

SEQ ID NO: 31827 - DNA, 203 bp, Homo sapiens; identical to SEQ ID NO: 9789
  source 1..203: mol_type = other DNA

SEQ ID NO: 31828 - DNA, 203 bp, Homo sapiens; identical to SEQ ID NO: 9792
  source 1..203: mol_type = other DNA

SEQ ID NO: 31829 - DNA, 203 bp, Homo sapiens; identical to SEQ ID NO: 9794
  source 1..203: mol_type = other DNA

SEQ ID NO: 31830 - DNA, 203 bp, Homo sapiens; identical to SEQ ID NO: 9796
  source 1..203: mol_type = other DNA

SEQ ID NO: 31831 - DNA, 203 bp, Homo sapiens; identical to SEQ ID NO: 9805
  source 1..203: mol_type = other DNA

SEQ ID NO: 31832 - DNA, 203 bp, Homo sapiens; identical to SEQ ID NO: 9812
  source 1..203: mol_type = other DNA

SEQ ID NO: 31833 - DNA, 203 bp, Homo sapiens; identical to SEQ ID NO: 9814
  source 1..203: mol_type = other DNA

SEQ ID NO: 31834 - DNA, 203 bp, Homo sapiens; identical to SEQ ID NO: 9816
  source 1..203: mol_type = other DNA

SEQ ID NO: 31835 - DNA, 203 bp, Homo sapiens; identical to SEQ ID NO: 9818
  source 1..203: mol_type = other DNA

SEQ ID NO: 31836 - DNA, 203 bp, Homo sapiens; identical to SEQ ID NO: 9820
  source 1..203: mol_type = other DNA

SEQ ID NO: 31837 - DNA, 203 bp, Homo sapiens; identical to SEQ ID NO: 9821
  source 1..203: mol_type = other DNA

SEQ ID NO: 31838 - DNA, 203 bp, Homo sapiens; identical to SEQ ID NO: 9832
  source 1..203: mol_type = other DNA

SEQ ID NO: 31839 - DNA, 203 bp, Homo sapiens; identical to SEQ ID NO: 9833
  source 1..203: mol_type = other DNA

SEQ ID NO: 31840 - DNA, 203 bp, Homo sapiens; identical to SEQ ID NO: 9834
  source 1..203: mol_type = other DNA

SEQ ID NO: 31841 - DNA, 203 bp, Homo sapiens; identical to SEQ ID NO: 9836
  source 1..203: mol_type = other DNA

SEQ ID NO: 31842 - DNA, 203 bp, Homo sapiens; identical to SEQ ID NO: 9841
  source 1..203: mol_type = other DNA

SEQ ID NO: 31843 - DNA, 203 bp, Homo sapiens; identical to SEQ ID NO: 9844
  source 1..203: mol_type = other DNA

SEQ ID NO: 31844 - DNA, 203 bp, Homo sapiens; identical to SEQ ID NO: 9846
  source 1..203: mol_type = other DNA

SEQ ID NO: 31845 - DNA, 203 bp, Homo sapiens; identical to SEQ ID NO: 9850
  source 1..203: mol_type = other DNA

SEQ ID NO: 31846 - DNA, 203 bp, Homo sapiens; identical to SEQ ID NO: 9859
  source 1..203: mol_type = other DNA

SEQ ID NO: 31847 - DNA, 203 bp, Homo sapiens; identical to SEQ ID NO: 9860
  source 1..203: mol_type = other DNA

SEQ ID NO: 31848 - DNA, 203 bp, Homo sapiens; identical to SEQ ID NO: 9861
  source 1..203: mol_type = other DNA

SEQ ID NO: 31849 - DNA, 203 bp, Homo sapiens; identical to SEQ ID NO: 9863
  source 1..203: mol_type = other DNA

SEQ ID NO: 31850 - DNA, 203 bp, Homo sapiens; identical to SEQ ID NO: 9865
  source 1..203: mol_type = other DNA

SEQ ID NO: 31851 - DNA, 203 bp, Homo sapiens; identical to SEQ ID NO: 9866
  source 1..203: mol_type = other DNA

SEQ ID NO: 31852 - DNA, 203 bp, Homo sapiens; identical to SEQ ID NO: 9869
  source 1..203: mol_type = other DNA

SEQ ID NO: 31853 - DNA, 203 bp, Homo sapiens; identical to SEQ ID NO: 9870
  source 1..203: mol_type = other DNA

SEQ ID NO: 31854 - DNA, 203 bp, Homo sapiens; identical to SEQ ID NO: 9877
  source 1..203: mol_type = other DNA

SEQ ID NO: 31855 - DNA, 203 bp, Homo sapiens; identical to SEQ ID NO: 9879
  source 1..203: mol_type = other DNA

SEQ ID NO: 31856 - DNA, 203 bp, Homo sapiens; identical to SEQ ID NO: 9886
  source 1..203: mol_type = other DNA

SEQ ID NO: 31857 - DNA, 203 bp, Homo sapiens; identical to SEQ ID NO: 9887
  source 1..203: mol_type = other DNA

SEQ ID NO: 31858 - DNA, 203 bp, Homo sapiens; identical to SEQ ID NO: 9888
  source 1..203: mol_type = other DNA

SEQ ID NO: 31859 - DNA, 203 bp, Homo sapiens; identical to SEQ ID NO: 9891
  source 1..203: mol_type = other DNA

SEQ ID NO: 31860 - DNA, 203 bp, Homo sapiens; identical to SEQ ID NO: 9892
  source 1..203: mol_type = other DNA

SEQ ID NO: 31861 - DNA, 203 bp, Homo sapiens; identical to SEQ ID NO: 9893
  source 1..203: mol_type = other DNA

SEQ ID NO: 31862 - DNA, 203 bp, Homo sapiens; identical to SEQ ID NO: 9894
  source 1..203: mol_type = other DNA

SEQ ID NO: 31863 - DNA, 203 bp, Homo sapiens; identical to SEQ ID NO: 9896
  source 1..203: mol_type = other DNA

SEQ ID NO: 31864 - DNA, 203 bp, Homo sapiens; identical to SEQ ID NO: 9902
  source 1..203: mol_type = other DNA

SEQ ID NO: 31865 - DNA, 203 bp, Homo sapiens; identical to SEQ ID NO: 9908
  source 1..203: mol_type = other DNA

SEQ ID NO: 31866 - DNA, 203 bp, Homo sapiens; identical to SEQ ID NO: 9910
  source 1..203: mol_type = other DNA

SEQ ID NO: 31867 - DNA, 203 bp, Homo sapiens; identical to SEQ ID NO: 9913
  source 1..203: mol_type = other DNA

SEQ ID NO: 31868 - DNA, 203 bp, Homo sapiens; identical to SEQ ID NO: 9921
  source 1..203: mol_type = other DNA

SEQ ID NO: 31869 - DNA, 203 bp, Homo sapiens; identical to SEQ ID NO: 9997
  source 1..203: mol_type = other DNA

SEQ ID NO: 31870 - DNA, 203 bp, Homo sapiens; identical to SEQ ID NO: 10081
  source 1..203: mol_type = other DNA

SEQ ID NO: 31871 - DNA, 203 bp, Homo sapiens; identical to SEQ ID NO: 10095
  source 1..203: mol_type = other DNA

SEQ ID NO: 31872 - DNA, 203 bp, Homo sapiens; identical to SEQ ID NO: 10096
  source 1..203: mol_type = other DNA

SEQ ID NO: 31873 - DNA, 203 bp, Homo sapiens; identical to SEQ ID NO: 10097
  source 1..203: mol_type = other DNA

SEQ ID NO: 31874 - DNA, 203 bp, Homo sapiens; identical to SEQ ID NO: 10098
  source 1..203: mol_type = other DNA

SEQ ID NO: 31875 - DNA, 203 bp, Homo sapiens; identical to SEQ ID NO: 10099
  source 1..203: mol_type = other DNA

SEQ ID NO: 31876 - DNA, 203 bp, Homo sapiens; identical to SEQ ID NO: 10100
  source 1..203: mol_type = other DNA

SEQ ID NO: 31877 - DNA, 203 bp, Homo sapiens; identical to SEQ ID NO: 10107
  source 1..203: mol_type = other DNA

SEQ ID NO: 31878 - DNA, 203 bp, Homo sapiens; identical to SEQ ID NO: 10108
  source 1..203: mol_type = other DNA

SEQ ID NO: 31879 - DNA, 203 bp, Homo sapiens; identical to SEQ ID NO: 10109
  source 1..203: mol_type = other DNA

SEQ ID NO: 31880 - DNA, 203 bp, Homo sapiens; identical to SEQ ID NO: 10110
  source 1..203: mol_type = other DNA

SEQ ID NO: 31881 - DNA, 203 bp, Homo sapiens; identical to SEQ ID NO: 10213
  source 1..203: mol_type = other DNA

SEQ ID NO: 31882 - DNA, 203 bp, Homo sapiens; identical to SEQ ID NO: 10214
  source 1..203: mol_type = other DNA

SEQ ID NO: 31883 - DNA, 203 bp, Homo sapiens; identical to SEQ ID NO: 10215
  source 1..203: mol_type = other DNA

SEQ ID NO: 31884 - DNA, 203 bp, Homo sapiens; identical to SEQ ID NO: 10216
  source 1..203: mol_type = other DNA

SEQ ID NO: 31885 - DNA, 203 bp, Homo sapiens; identical to SEQ ID NO: 10219
  source 1..203: mol_type = other DNA

SEQ ID NO: 31886 - DNA, 203 bp, Homo sapiens; identical to SEQ ID NO: 10225
  source 1..203: mol_type = other DNA

SEQ ID NO: 31887 - DNA, 203 bp, Homo sapiens; identical to SEQ ID NO: 10234
  source 1..203: mol_type = other DNA

SEQ ID NO: 31888 - DNA, 203 bp, Homo sapiens; identical to SEQ ID NO: 10235
  source 1..203: mol_type = other DNA

SEQ ID NO: 31889 - DNA, 203 bp, Homo sapiens; identical to SEQ ID NO: 10236
  source 1..203: mol_type = other DNA

SEQ ID NO: 31890 - DNA, 203 bp, Homo sapiens; identical to SEQ ID NO: 10250
  source 1..203: mol_type = other DNA

SEQ ID NO: 31891 - DNA, 203 bp, Homo sapiens; identical to SEQ ID NO: 10251
  source 1..203: mol_type = other DNA

SEQ ID NO: 31892 - DNA, 203 bp, Homo sapiens; identical to SEQ ID NO: 10252
  source 1..203: mol_type = other DNA

SEQ ID NO: 31893 - DNA, 203 bp, Homo sapiens; identical to SEQ ID NO: 10275
  source 1..203: mol_type = other DNA

SEQ ID NO: 31894 - DNA, 203 bp, Homo sapiens; identical to SEQ ID NO: 10276
  source 1..203: mol_type = other DNA

SEQ ID NO: 31895 - DNA, 203 bp, Homo sapiens; identical to SEQ ID NO: 10277
  source 1..203: mol_type = other DNA

SEQ ID NO: 31896 - DNA, 203 bp, Homo sapiens; identical to SEQ ID NO: 10278
  source 1..203: mol_type = other DNA

SEQ ID NO: 31897 - DNA, 203 bp, Homo sapiens; identical to SEQ ID NO: 10281
  source 1..203: mol_type = other DNA

SEQ ID NO: 31898 - DNA, 203 bp, Homo sapiens; identical to SEQ ID NO: 10286
  source 1..203: mol_type = other DNA

SEQ ID NO: 31899 - DNA, 203 bp, Homo sapiens; identical to SEQ ID NO: 10287
  source 1..203: mol_type = other DNA

SEQ ID NO: 31900 - DNA, 203 bp, Homo sapiens; identical to SEQ ID NO: 10288
  source 1..203: mol_type = other DNA

SEQ ID NO: 31901 - DNA, 203 bp, Homo sapiens; identical to SEQ ID NO: 10292
  source 1..203: mol_type = other DNA

SEQ ID NO: 31902 - DNA, 203 bp, Homo sapiens; identical to SEQ ID NO: 10293
  source 1..203: mol_type = other DNA

SEQ ID NO: 31903 - DNA, 203 bp, Homo sapiens; identical to SEQ ID NO: 10294
  source 1..203: mol_type = other DNA

SEQ ID NO: 31904 - DNA, 203 bp, Homo sapiens; identical to SEQ ID NO: 10295
  source 1..203: mol_type = other DNA

SEQ ID NO: 31905 - DNA, 203 bp, Homo sapiens; identical to SEQ ID NO: 10296
  source 1..203: mol_type = other DNA

SEQ ID NO: 31906 - DNA, 203 bp, Homo sapiens; identical to SEQ ID NO: 10297
  source 1..203: mol_type = other DNA

SEQ ID NO: 31907 - DNA, 203 bp, Homo sapiens; identical to SEQ ID NO: 10302
  source 1..203: mol_type = other DNA

SEQ ID NO: 31908 - DNA, 203 bp, Homo sapiens; identical to SEQ ID NO: 10303
  source 1..203: mol_type = other DNA

SEQ ID NO: 31909 - DNA, 203 bp, Homo sapiens; identical to SEQ ID NO: 10304
  source 1..203: mol_type = other DNA

SEQ ID NO: 31910 - DNA, 203 bp, Homo sapiens; identical to SEQ ID NO: 10305
  source 1..203: mol_type = other DNA

SEQ ID NO: 31911 - DNA, 203 bp, Homo sapiens; identical to SEQ ID NO: 10306
  source 1..203: mol_type = other DNA

SEQ ID NO: 31912 - DNA, 203 bp, Homo sapiens; identical to SEQ ID NO: 10307
  source 1..203: mol_type = other DNA

SEQ ID NO: 31913 - DNA, 203 bp, Homo sapiens; identical to SEQ ID NO: 10308
  source 1..203: mol_type = other DNA

SEQ ID NO: 31914 - DNA, 203 bp, Homo sapiens; identical to SEQ ID NO: 10309
  source 1..203: mol_type = other DNA

SEQ ID NO: 31915 - DNA, 203 bp, Homo sapiens; identical to SEQ ID NO: 10310
  source 1..203: mol_type = other DNA

SEQ ID NO: 31916 - DNA, 203 bp, Homo sapiens; identical to SEQ ID NO: 10311
  source 1..203: mol_type = other DNA

SEQ ID NO: 31917 - DNA, 203 bp, Homo sapiens; identical to SEQ ID NO: 10313
  source 1..203: mol_type = other DNA

SEQ ID NO: 31918 - DNA, 203 bp, Homo sapiens; identical to SEQ ID NO: 10316
  source 1..203: mol_type = other DNA

SEQ ID NO: 31919 - DNA, 203 bp, Homo sapiens; identical to SEQ ID NO: 10319
  source 1..203: mol_type = other DNA

SEQ ID NO: 31920 - DNA, 203 bp, Homo sapiens; identical to SEQ ID NO: 10320
  source 1..203: mol_type = other DNA

SEQ ID NO: 31921 - DNA, 203 bp, Homo sapiens; identical to SEQ ID NO: 10322
  source 1..203: mol_type = other DNA

SEQ ID NO: 31922 - DNA, 203 bp, Homo sapiens; identical to SEQ ID NO: 10323
  source 1..203: mol_type = other DNA

SEQ ID NO: 31923 - DNA, 203 bp, Homo sapiens; identical to SEQ ID NO: 10324
  source 1..203: mol_type = other DNA

SEQ ID NO: 31924 - DNA, 203 bp, Homo sapiens; identical to SEQ ID NO: 10325
  source 1..203: mol_type = other DNA

SEQ ID NO: 31925 - DNA, 203 bp, Homo sapiens; identical to SEQ ID NO: 10327
  source 1..203: mol_type = other DNA

SEQ ID NO: 31926 - DNA, 203 bp, Homo sapiens; identical to SEQ ID NO: 10328
  source 1..203: mol_type = other DNA

SEQ ID NO: 31927 - DNA, 203 bp, Homo sapiens; identical to SEQ ID NO: 10329
  source 1..203: mol_type = other DNA

SEQ ID NO: 31928 - DNA, 203 bp, Homo sapiens; identical to SEQ ID NO: 10343
  source 1..203: mol_type = other DNA

SEQ ID NO: 31929 - DNA, 203 bp, Homo sapiens; identical to SEQ ID NO: 10344
  source 1..203: mol_type = other DNA

SEQ ID NO: 31930 - DNA, 203 bp, Homo sapiens; identical to SEQ ID NO: 10345
  source 1..203: mol_type = other DNA

SEQ ID NO: 31931 - DNA, 203 bp, Homo sapiens; identical to SEQ ID NO: 10346
  source 1..203: mol_type = other DNA

SEQ ID NO: 31932 - DNA, 203 bp, Homo sapiens; identical to SEQ ID NO: 10347
  source 1..203: mol_type = other DNA

SEQ ID NO: 31933 - DNA, 203 bp, Homo sapiens; identical to SEQ ID NO: 10348
  source 1..203: mol_type = other DNA

SEQ ID NO: 31934 - DNA, 203 bp, Homo sapiens; identical to SEQ ID NO: 10349
  source 1..203: mol_type = other DNA

SEQ ID NO: 31935 - DNA, 203 bp, Homo sapiens; identical to SEQ ID NO: 10350
  source 1..203: mol_type = other DNA

SEQ ID NO: 31936 - DNA, 203 bp, Homo sapiens; identical to SEQ ID NO: 10351
  source 1..203: mol_type = other DNA

SEQ ID NO: 31937 - DNA, 203 bp, Homo sapiens; identical to SEQ ID NO: 10352
  source 1..203: mol_type = other DNA

SEQ ID NO: 31938 - DNA, 203 bp, Homo sapiens; identical to SEQ ID NO: 10353
  source 1..203: mol_type = other DNA

SEQ ID NO: 31939 - DNA, 203 bp, Homo sapiens; identical to SEQ ID NO: 10357
  source 1..203: mol_type = other DNA

SEQ ID NO: 31940 - DNA, 203 bp, Homo sapiens; identical to SEQ ID NO: 10358
  source 1..203: mol_type = other DNA

SEQ ID NO: 31941 - DNA, 203 bp, Homo sapiens; identical to SEQ ID NO: 10359
  source 1..203: mol_type = other DNA

SEQ ID NO: 31942 - DNA, 203 bp, Homo sapiens; identical to SEQ ID NO: 10372
  source 1..203: mol_type = other DNA

SEQ ID NO: 31943 - DNA, 203 bp, Homo sapiens; identical to SEQ ID NO: 10373
  source 1..203: mol_type = other DNA

SEQ ID NO: 31944 - DNA, 203 bp, Homo sapiens; identical to SEQ ID NO: 10374
  source 1..203: mol_type = other DNA

SEQ ID NO: 31945 - DNA, 203 bp, Homo sapiens; identical to SEQ ID NO: 10377
  source 1..203: mol_type = other DNA

SEQ ID NO: 31946 - DNA, 203 bp, Homo sapiens; identical to SEQ ID NO: 10378
  source 1..203: mol_type = other DNA

SEQ ID NO: 31947 - DNA, 203 bp, Homo sapiens; identical to SEQ ID NO: 10379
  source 1..203: mol_type = other DNA

SEQ ID NO: 31948 - DNA, 203 bp, Homo sapiens; identical to SEQ ID NO: 10382
  source 1..203: mol_type = other DNA

SEQ ID NO: 31949 - DNA, 203 bp, Homo sapiens; identical to SEQ ID NO: 10383
  source 1..203: mol_type = other DNA

SEQ ID NO: 31950 - DNA, 203 bp, Homo sapiens; identical to SEQ ID NO: 10384
  source 1..203: mol_type = other DNA

SEQ ID NO: 31951 - DNA, 203 bp, Homo sapiens; identical to SEQ ID NO: 10386
  source 1..203: mol_type = other DNA

SEQ ID NO: 31952 - DNA, 203 bp, Homo sapiens; identical to SEQ ID NO: 10387
  source 1..203: mol_type = other DNA

SEQ ID NO: 31953 - DNA, 203 bp, Homo sapiens; identical to SEQ ID NO: 10388
  source 1..203: mol_type = other DNA

SEQ ID NO: 31954 - DNA, 203 bp, Homo sapiens; identical to SEQ ID NO: 10408
  source 1..203: mol_type = other DNA

SEQ ID NO: 31955 - DNA, 203 bp, Homo sapiens; identical to SEQ ID NO: 10409
  source 1..203: mol_type = other DNA

SEQ ID NO: 31956 - DNA, 203 bp, Homo sapiens; identical to SEQ ID NO: 10410
  source 1..203: mol_type = other DNA

SEQ ID NO: 31957 - DNA, 203 bp, Homo sapiens; identical to SEQ ID NO: 10416
  source 1..203: mol_type = other DNA

SEQ ID NO: 31958 - DNA, 203 bp, Homo sapiens; identical to SEQ ID NO: 10417
  source 1..203: mol_type = other DNA

SEQ ID NO: 31959 - DNA, 203 bp, Homo sapiens; identical to SEQ ID NO: 10426
  source 1..203: mol_type = other DNA

SEQ ID NO: 31960 - DNA, 203 bp, Homo sapiens; identical to SEQ ID NO: 10428
  source 1..203: mol_type = other DNA

SEQ ID NO: 31961 - DNA, 203 bp, Homo sapiens; identical to SEQ ID NO: 10448
  source 1..203: mol_type = other DNA

SEQ ID NO: 31962 - DNA, 203 bp, Homo sapiens; identical to SEQ ID NO: 10454
  source 1..203: mol_type = other DNA

SEQ ID NO: 31963 - DNA, 203 bp, Homo sapiens; identical to SEQ ID NO: 10462
  source 1..203: mol_type = other DNA

SEQ ID NO: 31964 - DNA, 203 bp, Homo sapiens; identical to SEQ ID NO: 10465
  source 1..203: mol_type = other DNA

SEQ ID NO: 31965 - DNA, 203 bp, Homo sapiens; identical to SEQ ID NO: 10469
  source 1..203: mol_type = other DNA

SEQ ID NO: 31966 - DNA, 203 bp, Homo sapiens; identical to SEQ ID NO: 10472
  source 1..203: mol_type = other DNA

SEQ ID NO: 31967 - DNA, 203 bp, Homo sapiens; identical to SEQ ID NO: 10473
  source 1..203: mol_type = other DNA

SEQ ID NO: 31968 - DNA, 203 bp, Homo sapiens; identical to SEQ ID NO: 10481
  source 1..203: mol_type = other DNA

SEQ ID NO: 31969 - DNA, 203 bp, Homo sapiens; identical to SEQ ID NO: 10482
  source 1..203: mol_type = other DNA

SEQ ID NO: 31970 - DNA, 203 bp, Homo sapiens; identical to SEQ ID NO: 10485
  source 1..203: mol_type = other DNA

SEQ ID NO: 31971 - DNA, 203 bp, Homo sapiens; identical to SEQ ID NO: 10486
  source 1..203: mol_type = other DNA

SEQ ID NO: 31972 - DNA, 203 bp, Homo sapiens; identical to SEQ ID NO: 10490
  source 1..203: mol_type = other DNA

SEQ ID NO: 31973 - DNA, 203 bp, Homo sapiens; identical to SEQ ID NO: 10494
  source 1..203: mol_type = other DNA

SEQ ID NO: 31974 - DNA, 203 bp, Homo sapiens; identical to SEQ ID NO: 10495
  source 1..203: mol_type = other DNA

SEQ ID NO: 31975 - DNA, 203 bp, Homo sapiens; identical to SEQ ID NO: 10496
  source 1..203: mol_type = other DNA

SEQ ID NO: 31976 - DNA, 203 bp, Homo sapiens; identical to SEQ ID NO: 10497
  source 1..203: mol_type = other DNA

SEQ ID NO: 31977 - DNA, 203 bp, Homo sapiens; identical to SEQ ID NO: 10500
  source 1..203: mol_type = other DNA

SEQ ID NO: 31978 - DNA, 203 bp, Homo sapiens; identical to SEQ ID NO: 10502
  source 1..203: mol_type = other DNA

SEQ ID NO: 31979 - DNA, 203 bp, Homo sapiens; identical to SEQ ID NO: 10505
  source 1..203: mol_type = other DNA

SEQ ID NO: 31980 - DNA, 203 bp, Homo sapiens; identical to SEQ ID NO: 10507
  source 1..203: mol_type = other DNA

SEQ ID NO: 31981 - DNA, 203 bp, Homo sapiens; identical to SEQ ID NO: 10513
  source 1..203: mol_type = other DNA

SEQ ID NO: 31982 - DNA, 203 bp, Homo sapiens; identical to SEQ ID NO: 10525
  source 1..203: mol_type = other DNA

SEQ ID NO: 31983 - DNA, 203 bp, Homo sapiens; identical to SEQ ID NO: 10534
  source 1..203: mol_type = other DNA

SEQ ID NO: 31984 - DNA, 203 bp, Homo sapiens; identical to SEQ ID NO: 10539
  source 1..203: mol_type = other DNA

SEQ ID NO: 31985 - DNA, 203 bp, Homo sapiens; identical to SEQ ID NO: 10597
  source 1..203: mol_type = other DNA

SEQ ID NO: 31986 - DNA, 203 bp, Homo sapiens; identical to SEQ ID NO: 10603
  source 1..203: mol_type = other DNA

SEQ ID NO: 31987 - DNA, 203 bp, Homo sapiens; identical to SEQ ID NO: 10604
  source 1..203: mol_type = other DNA

SEQ ID NO: 31988 - DNA, 203 bp, Homo sapiens; identical to SEQ ID NO: 10624
  source 1..203: mol_type = other DNA

SEQ ID NO: 31989 - DNA, 203 bp, Homo sapiens; identical to SEQ ID NO: 10625
  source 1..203: mol_type = other DNA

SEQ ID NO: 31990 - DNA, 203 bp, Homo sapiens; identical to SEQ ID NO: 10626
  source 1..203: mol_type = other DNA

SEQ ID NO: 31991 - DNA, 203 bp, Homo sapiens; identical to SEQ ID NO: 10627
  source 1..203: mol_type = other DNA

SEQ ID NO: 31992 - DNA, 203 bp, Homo sapiens; identical to SEQ ID NO: 10647
  source 1..203: mol_type = other DNA

SEQ ID NO: 31993 - DNA, 203 bp, Homo sapiens; identical to SEQ ID NO: 10649
  source 1..203: mol_type = other DNA

SEQ ID NO: 31994 - DNA, 203 bp, Homo sapiens; identical to SEQ ID NO: 10650
  source 1..203: mol_type = other DNA

SEQ ID NO: 31995 - DNA, 203 bp, Homo sapiens; identical to SEQ ID NO: 10651
  source 1..203: mol_type = other DNA

SEQ ID NO: 31996 - DNA, 203 bp, Homo sapiens; identical to SEQ ID NO: 10665
  source 1..203: mol_type = other DNA

SEQ ID NO: 31997 - DNA, 203 bp, Homo sapiens; identical to SEQ ID NO: 10666
  source 1..203: mol_type = other DNA

SEQ ID NO: 31998 - DNA, 203 bp, Homo sapiens; identical to SEQ ID NO: 10668
  source 1..203: mol_type = other DNA

SEQ ID NO: 31999 - DNA, 203 bp, Homo sapiens; identical to SEQ ID NO: 10672
  source 1..203: mol_type = other DNA

SEQ ID NO: 32000 - DNA, 203 bp, Homo sapiens; identical to SEQ ID NO: 10673
  source 1..203: mol_type = other DNA

SEQ ID NO: 32001 - DNA, 203 bp, Homo sapiens; identical to SEQ ID NO: 10678
  source 1..203: mol_type = other DNA

SEQ ID NO: 32002 - DNA, 203 bp, Homo sapiens; identical to SEQ ID NO: 10691
  source 1..203: mol_type = other DNA

SEQ ID NO: 32003 - DNA, 203 bp, Homo sapiens; identical to SEQ ID NO: 10692
  source 1..203: mol_type = other DNA

SEQ ID NO: 32004 - DNA, 203 bp, Homo sapiens; identical to SEQ ID NO: 10697
  source 1..203: mol_type = other DNA

SEQ ID NO: 32005 - DNA, 203 bp, Homo sapiens; identical to SEQ ID NO: 10723
  source 1..203: mol_type = other DNA

SEQ ID NO: 32006 - DNA, 203 bp, Homo sapiens; identical to SEQ ID NO: 10725
  source 1..203: mol_type = other DNA

SEQ ID NO: 32007 - DNA, 203 bp, Homo sapiens; identical to SEQ ID NO: 10727
  source 1..203: mol_type = other DNA

SEQ ID NO: 32008 - DNA, 203 bp, Homo sapiens; identical to SEQ ID NO: 10733
  source 1..203: mol_type = other DNA

SEQ ID NO: 32009 - DNA, 203 bp, Homo sapiens; identical to SEQ ID NO: 10751
  source 1..203: mol_type = other DNA

SEQ ID NO: 32010 - DNA, 203 bp, Homo sapiens; identical to SEQ ID NO: 10752
  source 1..203: mol_type = other DNA

SEQ ID NO: 32011 - DNA, 203 bp, Homo sapiens; identical to SEQ ID NO: 10766
  source 1..203: mol_type = other DNA

SEQ ID NO: 32012 - DNA, 203 bp, Homo sapiens; identical to SEQ ID NO: 10767
  source 1..203: mol_type = other DNA

SEQ ID NO: 32013 - DNA, 203 bp, Homo sapiens; identical to SEQ ID NO: 10768
  source 1..203: mol_type = other DNA

SEQ ID NO: 32014 - DNA, 203 bp, Homo sapiens; identical to SEQ ID NO: 10769
  source 1..203: mol_type = other DNA

SEQ ID NO: 32015 - DNA, 203 bp, Homo sapiens; identical to SEQ ID NO: 10771
  source 1..203: mol_type = other DNA

SEQ ID NO: 32016 - DNA, 203 bp, Homo sapiens; identical to SEQ ID NO: 10772
  source 1..203: mol_type = other DNA

SEQ ID NO: 32017 - DNA, 203 bp, Homo sapiens; identical to SEQ ID NO: 10773
  source 1..203: mol_type = other DNA

SEQ ID NO: 32018 - DNA, 203 bp, Homo sapiens; identical to SEQ ID NO: 10774
  source 1..203: mol_type = other DNA

SEQ ID NO: 32019 - DNA, 203 bp, Homo sapiens; identical to SEQ ID NO: 10786
  source 1..203: mol_type = other DNA

SEQ ID NO: 32020 - DNA, 203 bp, Homo sapiens; identical to SEQ ID NO: 10789
  source 1..203: mol_type = other DNA

SEQ ID NO: 32021 - DNA, 203 bp, Homo sapiens; identical to SEQ ID NO: 10792
  source 1..203: mol_type = other DNA

SEQ ID NO: 32022 - DNA, 203 bp, Homo sapiens; identical to SEQ ID NO: 10801
  source 1..203: mol_type = other DNA

SEQ ID NO: 32023 - DNA, 203 bp, Homo sapiens; identical to SEQ ID NO: 10802
  source 1..203: mol_type = other DNA

SEQ ID NO: 32024 - DNA, 203 bp, Homo sapiens; identical to SEQ ID NO: 10803
  source 1..203: mol_type = other DNA

SEQ ID NO: 32025 - DNA, 203 bp, Homo sapiens; identical to SEQ ID NO: 10815
  source 1..203: mol_type = other DNA

SEQ ID NO: 32026 - DNA, 203 bp, Homo sapiens; identical to SEQ ID NO: 10856
  source 1..203: mol_type = other DNA

SEQ ID NO: 32027 - DNA, 203 bp, Homo sapiens; identical to SEQ ID NO: 10860
  source 1..203: mol_type = other DNA

SEQ ID NO: 32028 - DNA, 203 bp, Homo sapiens; identical to SEQ ID NO: 10861
  source 1..203: mol_type = other DNA

SEQ ID NO: 32029 - DNA, 203 bp, Homo sapiens; identical to SEQ ID NO: 10863
  source 1..203: mol_type = other DNA

SEQ ID NO: 32030 - DNA, 203 bp, Homo sapiens; identical to SEQ ID NO: 10864
  source 1..203: mol_type = other DNA

SEQ ID NO: 32031 - DNA, 203 bp, Homo sapiens; identical to SEQ ID NO: 10865
  source 1..203: mol_type = other DNA

SEQ ID NO: 32032 - DNA, 203 bp, Homo sapiens; identical to SEQ ID NO: 10870
  source 1..203: mol_type = other DNA

SEQ ID NO: 32033 - DNA, 203 bp, Homo sapiens; identical to SEQ ID NO: 10871
  source 1..203: mol_type = other DNA

SEQ ID NO: 32034 - DNA, 203 bp, Homo sapiens; identical to SEQ ID NO: 10873
  source 1..203: mol_type = other DNA

SEQ ID NO: 32035 - DNA, 203 bp, Homo sapiens; identical to SEQ ID NO: 10903
  source 1..203: mol_type = other DNA

SEQ ID NO: 32036 - DNA, 203 bp, Homo sapiens; identical to SEQ ID NO: 10929
  source 1..203: mol_type = other DNA

SEQ ID NO: 32037 - DNA, 203 bp, Homo sapiens; identical to SEQ ID NO: 10930
  source 1..203: mol_type = other DNA

SEQ ID NO: 32038 - DNA, 203 bp, Homo sapiens; identical to SEQ ID NO: 10931
  source 1..203: mol_type = other DNA

SEQ ID NO: 32039 - DNA, 203 bp, Homo sapiens; identical to SEQ ID NO: 10932
  source 1..203: mol_type = other DNA

SEQ ID NO: 32040 - DNA, 203 bp, Homo sapiens; identical to SEQ ID NO: 10933
  source 1..203: mol_type = other DNA

SEQ ID NO: 32041 - DNA, 203 bp, Homo sapiens; identical to SEQ ID NO: 10935
  source 1..203: mol_type = other DNA

SEQ ID NO: 32042 - DNA, 203 bp, Homo sapiens; identical to SEQ ID NO: 10944
  source 1..203: mol_type = other DNA

SEQ ID NO: 32043 - DNA, 203 bp, Homo sapiens; identical to SEQ ID NO: 10948
  source 1..203: mol_type = other DNA

SEQ ID NO: 32044 - DNA, 203 bp, Homo sapiens; identical to SEQ ID NO: 10950
  source 1..203: mol_type = other DNA

SEQ ID NO: 32045 - DNA, 203 bp, Homo sapiens; identical to SEQ ID NO: 10953
  source 1..203: mol_type = other DNA

SEQ ID NO: 32046 - DNA, 203 bp, Homo sapiens; identical to SEQ ID NO: 10955
  source 1..203: mol_type = other DNA

SEQ ID NO: 32047 - DNA, 203 bp, Homo sapiens; identical to SEQ ID NO: 10959
  source 1..203: mol_type = other DNA

SEQ ID NO: 32048 - DNA, 203 bp, Homo sapiens; identical to SEQ ID NO: 10960
  source 1..203: mol_type = other DNA

SEQ ID NO: 32049 - DNA, 203 bp, Homo sapiens; identical to SEQ ID NO: 10961
  source 1..203: mol_type = other DNA

SEQ ID NO: 32050 - DNA, 203 bp, Homo sapiens; identical to SEQ ID NO: 10962
  source 1..203: mol_type = other DNA

SEQ ID NO: 32051 - DNA, 203 bp, Homo sapiens; identical to SEQ ID NO: 10963
  source 1..203: mol_type = other DNA

SEQ ID NO: 32052 - DNA, 203 bp, Homo sapiens; identical to SEQ ID NO: 10964
  source 1..203: mol_type = other DNA

SEQ ID NO: 32053 - DNA, 203 bp, Homo sapiens; identical to SEQ ID NO: 10965
  source 1..203: mol_type = other DNA

SEQ ID NO: 32054 - DNA, 203 bp, Homo sapiens; identical to SEQ ID NO: 10973
  source 1..203: mol_type = other DNA

SEQ ID NO: 32055 - DNA, 203 bp, Homo sapiens; identical to SEQ ID NO: 10978
  source 1..203: mol_type = other DNA

SEQ ID NO: 32056 - DNA, 203 bp, Homo sapiens; identical to SEQ ID NO: 11013
  source 1..203: mol_type = other DNA

SEQ ID NO: 32057 - DNA, 203 bp, Homo sapiens; identical to SEQ ID NO: 11018
  source 1..203: mol_type = other DNA

SEQ ID NO: 32058 - DNA, 203 bp, Homo sapiens; identical to SEQ ID NO: 11025
  source 1..203: mol_type = other DNA

SEQ ID NO: 32059 - DNA, 203 bp, Homo sapiens; identical to SEQ ID NO: 11026
  source 1..203: mol_type = other DNA

SEQ ID NO: 32060 - DNA, 203 bp, Homo sapiens; identical to SEQ ID NO: 11030
  source 1..203: mol_type = other DNA

SEQ ID NO: 32061 - DNA, 203 bp, Homo sapiens; identical to SEQ ID NO: 11041
  source 1..203: mol_type = other DNA

SEQ ID NO: 32062 - DNA, 203 bp, Homo sapiens; identical to SEQ ID NO: 11042
  source 1..203: mol_type = other DNA

SEQ ID NO: 32063 - DNA, 203 bp, Homo sapiens; identical to SEQ ID NO: 11043
  source 1..203: mol_type = other DNA

SEQ ID NO: 32064 - DNA, 203 bp, Homo sapiens; identical to SEQ ID NO: 11045
  source 1..203: mol_type = other DNA

SEQ ID NO: 32065 - DNA, 203 bp, Homo sapiens; identical to SEQ ID NO: 11047
  source 1..203: mol_type = other DNA

SEQ ID NO: 32066 - DNA, 203 bp, Homo sapiens; identical to SEQ ID NO: 11067
  source 1..203: mol_type = other DNA

SEQ ID NO: 32067 - DNA, 203 bp, Homo sapiens; identical to SEQ ID NO: 11068
  source 1..203: mol_type = other DNA

SEQ ID NO: 32068 - DNA, 203 bp, Homo sapiens; identical to SEQ ID NO: 11069
  source 1..203: mol_type = other DNA

SEQ ID NO: 32069 - DNA, 203 bp, Homo sapiens; identical to SEQ ID NO: 11081
  source 1..203: mol_type = other DNA

SEQ ID NO: 32070 - DNA, 203 bp, Homo sapiens; identical to SEQ ID NO: 11082
  source 1..203: mol_type = other DNA

SEQ ID NO: 32071 - DNA, 203 bp, Homo sapiens; identical to SEQ ID NO: 11084
  source 1..203: mol_type = other DNA

SEQ ID NO: 32072 - DNA, 203 bp, Homo sapiens; identical to SEQ ID NO: 11085
  source 1..203: mol_type = other DNA

SEQ ID NO: 32073 - DNA, 203 bp, Homo sapiens; identical to SEQ ID NO: 11104
  source 1..203: mol_type = other DNA

SEQ ID NO: 32074 - DNA, 203 bp, Homo sapiens; identical to SEQ ID NO: 11105
  source 1..203: mol_type = other DNA

SEQ ID NO: 32075 - DNA, 203 bp, Homo sapiens; identical to SEQ ID NO: 11106
  source 1..203: mol_type = other DNA

SEQ ID NO: 32076 - DNA, 203 bp, Homo sapiens; identical to SEQ ID NO: 11112
  source 1..203: mol_type = other DNA

SEQ ID NO: 32077 - DNA, 203 bp, Homo sapiens; identical to SEQ ID NO: 11120
  source 1..203: mol_type = other DNA

SEQ ID NO: 32078 - DNA, 203 bp, Homo sapiens; identical to SEQ ID NO: 11121
  source 1..203: mol_type = other DNA

SEQ ID NO: 32079 - DNA, 203 bp, Homo sapiens; identical to SEQ ID NO: 11122
  source 1..203: mol_type = other DNA

SEQ ID NO: 32080 - DNA, 203 bp, Homo sapiens; identical to SEQ ID NO: 11123
  source 1..203: mol_type = other DNA

SEQ ID NO: 32081 - DNA, 203 bp, Homo sapiens; identical to SEQ ID NO: 11125
  source 1..203: mol_type = other DNA

SEQ ID NO: 32082 - DNA, 203 bp, Homo sapiens; identical to SEQ ID NO: 11134
  source 1..203: mol_type = other DNA

SEQ ID NO: 32083 - DNA, 203 bp, Homo sapiens; identical to SEQ ID NO: 11178
  source 1..203: mol_type = other DNA

SEQ ID NO: 32084 - DNA, 203 bp, Homo sapiens; identical to SEQ ID NO: 11179
  source 1..203: mol_type = other DNA

SEQ ID NO: 32085 - DNA, 203 bp, Homo sapiens; identical to SEQ ID NO: 11181
  source 1..203: mol_type = other DNA

SEQ ID NO: 32086 - DNA, 203 bp, Homo sapiens; identical to SEQ ID NO: 11200
  source 1..203: mol_type = other DNA

SEQ ID NO: 32087 - DNA, 203 bp, Homo sapiens; identical to SEQ ID NO: 11212
  source 1..203: mol_type = other DNA

SEQ ID NO: 32088 - DNA, 203 bp, Homo sapiens; identical to SEQ ID NO: 11244
  source 1..203: mol_type = other DNA

SEQ ID NO: 32089 - DNA, 203 bp, Homo sapiens; identical to SEQ ID NO: 11282
  source 1..203: mol_type = other DNA

SEQ ID NO: 32090 - DNA, 203 bp, Homo sapiens; identical to SEQ ID NO: 11283
  source 1..203: mol_type = other DNA

SEQ ID NO: 32091 - DNA, 203 bp, Homo sapiens; identical to SEQ ID NO: 11292
  source 1..203: mol_type = other DNA

SEQ ID NO: 32092 - DNA, 203 bp, Homo sapiens; identical to SEQ ID NO: 11293
  source 1..203: mol_type = other DNA

SEQ ID NO: 32093 - DNA, 203 bp, Homo sapiens; identical to SEQ ID NO: 11313
  source 1..203: mol_type = other DNA

SEQ ID NO: 32094 - DNA, 203 bp, Homo sapiens; identical to SEQ ID NO: 11314
  source 1..203: mol_type = other DNA

SEQ ID NO: 32095 - DNA, 203 bp, Homo sapiens; identical to SEQ ID NO: 11317
  source 1..203: mol_type = other DNA

SEQ ID NO: 32096 - DNA, 203 bp, Homo sapiens; identical to SEQ ID NO: 11318
  source 1..203: mol_type = other DNA

SEQ ID NO: 32097 - DNA, 203 bp, Homo sapiens; identical to SEQ ID NO: 11342
  source 1..203: mol_type = other DNA

SEQ ID NO: 32098 - DNA, 203 bp, Homo sapiens; identical to SEQ ID NO: 11343
  source 1..203: mol_type = other DNA

SEQ ID NO: 32099 - DNA, 203 bp, Homo sapiens; identical to SEQ ID NO: 11344
  source 1..203: mol_type = other DNA

SEQ ID NO: 32100 - DNA, 203 bp, Homo sapiens; identical to SEQ ID NO: 11345
  source 1..203: mol_type = other DNA

SEQ ID NO: 32101 - DNA, 203 bp, Homo sapiens; identical to SEQ ID NO: 11346
  source 1..203: mol_type = other DNA

SEQ ID NO: 32102 - DNA, 203 bp, Homo sapiens; identical to SEQ ID NO: 11347
  source 1..203: mol_type = other DNA

SEQ ID NO: 32103 - DNA, 203 bp, Homo sapiens; identical to SEQ ID NO: 11348
  source 1..203: mol_type = other DNA

SEQ ID NO: 32104 - DNA, 203 bp, Homo sapiens; identical to SEQ ID NO: 11349
  source 1..203: mol_type = other DNA

SEQ ID NO: 32105 - DNA, 203 bp, Homo sapiens; identical to SEQ ID NO: 11350
  source 1..203: mol_type = other DNA

SEQ ID NO: 32106 - DNA, 203 bp, Homo sapiens; identical to SEQ ID NO: 11351
  source 1..203: mol_type = other DNA

SEQ ID NO: 32107 - DNA, 203 bp, Homo sapiens; identical to SEQ ID NO: 11352
  source 1..203: mol_type = other DNA

SEQ ID NO: 32108 - DNA, 203 bp, Homo sapiens; identical to SEQ ID NO: 11353
  source 1..203: mol_type = other DNA

SEQ ID NO: 32109 - DNA, 203 bp, Homo sapiens; identical to SEQ ID NO: 11354
  source 1..203: mol_type = other DNA

SEQ ID NO: 32110 - DNA, 203 bp, Homo sapiens; identical to SEQ ID NO: 11355
  source 1..203: mol_type = other DNA

SEQ ID NO: 32111 - DNA, 203 bp, Homo sapiens; identical to SEQ ID NO: 11357
  source 1..203: mol_type = other DNA

SEQ ID NO: 32112 - DNA, 203 bp, Homo sapiens; identical to SEQ ID NO: 11359
  source 1..203: mol_type = other DNA

SEQ ID NO: 32113 - DNA, 203 bp, Homo sapiens; identical to SEQ ID NO: 11360
  source 1..203: mol_type = other DNA

SEQ ID NO: 32114 - DNA, 203 bp, Homo sapiens; identical to SEQ ID NO: 11361
  source 1..203: mol_type = other DNA

SEQ ID NO: 32115 - DNA, 203 bp, Homo sapiens; identical to SEQ ID NO: 11363
  source 1..203: mol_type = other DNA

SEQ ID NO: 32116 - DNA, 203 bp, Homo sapiens; identical to SEQ ID NO: 11364
  source 1..203: mol_type = other DNA

SEQ ID NO: 32117 - DNA, 203 bp, Homo sapiens; identical to SEQ ID NO: 11365
  source 1..203: mol_type = other DNA

SEQ ID NO: 32118 - DNA, 203 bp, Homo sapiens; identical to SEQ ID NO: 11367
  source 1..203: mol_type = other DNA

SEQ ID NO: 32119 - DNA, 203 bp, Homo sapiens; identical to SEQ ID NO: 11368
  source 1..203: mol_type = other DNA

SEQ ID NO: 32120 - DNA, 203 bp, Homo sapiens; identical to SEQ ID NO: 11369
  source 1..203: mol_type = other DNA

SEQ ID NO: 32121 - DNA, 203 bp, Homo sapiens; identical to SEQ ID NO: 11370
  source 1..203: mol_type = other DNA

SEQ ID NO: 32122 - DNA, 203 bp, Homo sapiens; identical to SEQ ID NO: 11385
  source 1..203: mol_type = other DNA

SEQ ID NO: 32123 - DNA, 203 bp, Homo sapiens; identical to SEQ ID NO: 11386
  source 1..203: mol_type = other DNA

SEQ ID NO: 32124 - DNA, 203 bp, Homo sapiens; identical to SEQ ID NO: 11387
  source 1..203: mol_type = other DNA

SEQ ID NO: 32125 - DNA, 203 bp, Homo sapiens; identical to SEQ ID NO: 11388
  source 1..203: mol_type = other DNA

SEQ ID NO: 32126 - DNA, 203 bp, Homo sapiens; identical to SEQ ID NO: 11389
  source 1..203: mol_type = other DNA

SEQ ID NO: 32127 - DNA, 203 bp, Homo sapiens; identical to SEQ ID NO: 11395
  source 1..203: mol_type = other DNA

SEQ ID NO: 32128 - DNA, 203 bp, Homo sapiens; identical to SEQ ID NO: 11396
  source 1..203: mol_type = other DNA

SEQ ID NO: 32129 - DNA, 203 bp, Homo sapiens; identical to SEQ ID NO: 11397
  source 1..203: mol_type = other DNA

SEQ ID NO: 32130 - DNA, 203 bp, Homo sapiens; identical to SEQ ID NO: 11398
  source 1..203: mol_type = other DNA

SEQ ID NO: 32131 - DNA, 203 bp, Homo sapiens; identical to SEQ ID NO: 11404
  source 1..203: mol_type = other DNA

SEQ ID NO: 32132 - DNA, 203 bp, Homo sapiens; identical to SEQ ID NO: 11405
  source 1..203: mol_type = other DNA

SEQ ID NO: 32133 - DNA, 203 bp, Homo sapiens; identical to SEQ ID NO: 11411
  source 1..203: mol_type = other DNA

SEQ ID NO: 32134 - DNA, 203 bp, Homo sapiens; identical to SEQ ID NO: 11412
  source 1..203: mol_type = other DNA

SEQ ID NO: 32135 - DNA, 203 bp, Homo sapiens; identical to SEQ ID NO: 11413
  source 1..203: mol_type = other DNA

SEQ ID NO: 32136 - DNA, 203 bp, Homo sapiens; identical to SEQ ID NO: 11439
  source 1..203: mol_type = other DNA

SEQ ID NO: 32137 - DNA, 203 bp, Homo sapiens; identical to SEQ ID NO: 11451
  source 1..203: mol_type = other DNA

SEQ ID NO: 32138 - DNA, 203 bp, Homo sapiens; identical to SEQ ID NO: 11461
  source 1..203: mol_type = other DNA

SEQ ID NO: 32139 - DNA, 203 bp, Homo sapiens; identical to SEQ ID NO: 11462
  source 1..203: mol_type = other DNA

SEQ ID NO: 32140 - DNA, 203 bp, Homo sapiens; identical to SEQ ID NO: 11466
  source 1..203: mol_type = other DNA

SEQ ID NO: 32141 - DNA, 203 bp, Homo sapiens; identical to SEQ ID NO: 11481
  source 1..203: mol_type = other DNA

SEQ ID NO: 32142 - DNA, 203 bp, Homo sapiens; identical to SEQ ID NO: 11483
  source 1..203: mol_type = other DNA

SEQ ID NO: 32143 - DNA, 203 bp, Homo sapiens; identical to SEQ ID NO: 11504
  source 1..203: mol_type = other DNA

SEQ ID NO: 32144 - DNA, 203 bp, Homo sapiens; identical to SEQ ID NO: 11505
  source 1..203: mol_type = other DNA

SEQ ID NO: 32145 - DNA, 203 bp, Homo sapiens; identical to SEQ ID NO: 11517
  source 1..203: mol_type = other DNA

SEQ ID NO: 32146 - DNA, 203 bp, Homo sapiens; identical to SEQ ID NO: 11518
  source 1..203: mol_type = other DNA

SEQ ID NO: 32147 - DNA, 203 bp, Homo sapiens; identical to SEQ ID NO: 11519
  source 1..203: mol_type = other DNA

SEQ ID NO: 32148 - DNA, 203 bp, Homo sapiens; identical to SEQ ID NO: 11521
  source 1..203: mol_type = other DNA

SEQ ID NO: 32149 - DNA, 203 bp, Homo sapiens; identical to SEQ ID NO: 11522
  source 1..203: mol_type = other DNA

SEQ ID NO: 32150 - DNA, 203 bp, Homo sapiens; identical to SEQ ID NO: 11523
  source 1..203: mol_type = other DNA

SEQ ID NO: 32151 - DNA, 203 bp, Homo sapiens; identical to SEQ ID NO: 11545
  source 1..203: mol_type = other DNA

SEQ ID NO: 32152 - DNA, 203 bp, Homo sapiens; identical to SEQ ID NO: 11546
  source 1..203: mol_type = other DNA

SEQ ID NO: 32153 - DNA, 203 bp, Homo sapiens; identical to SEQ ID NO: 11547
  source 1..203: mol_type = other DNA

SEQ ID NO: 32154 - DNA, 203 bp, Homo sapiens; identical to SEQ ID NO: 11548
  source 1..203: mol_type = other DNA

SEQ ID NO: 32155 - DNA, 203 bp, Homo sapiens; identical to SEQ ID NO: 11559
  source 1..203: mol_type = other DNA

SEQ ID NO: 32156 - DNA, 203 bp, Homo sapiens; identical to SEQ ID NO: 11565
  source 1..203: mol_type = other DNA

SEQ ID NO: 32157 - DNA, 203 bp, Homo sapiens; identical to SEQ ID NO: 11566
  source 1..203: mol_type = other DNA

SEQ ID NO: 32158 - DNA, 203 bp, Homo sapiens; identical to SEQ ID NO: 11569
  source 1..203: mol_type = other DNA

SEQ ID NO: 32159 - DNA, 203 bp, Homo sapiens; identical to SEQ ID NO: 11570
  source 1..203: mol_type = other DNA

SEQ ID NO: 32160 - DNA, 203 bp, Homo sapiens; identical to SEQ ID NO: 11571
  source 1..203: mol_type = other DNA

SEQ ID NO: 32161 - DNA, 203 bp, Homo sapiens; identical to SEQ ID NO: 11572
  source 1..203: mol_type = other DNA

SEQ ID NO: 32162 - DNA, 203 bp, Homo sapiens; identical to SEQ ID NO: 11581
  source 1..203: mol_type = other DNA

SEQ ID NO: 32163 - DNA, 203 bp, Homo sapiens; identical to SEQ ID NO: 11582
  source 1..203: mol_type = other DNA

SEQ ID NO: 32164 - DNA, 203 bp, Homo sapiens; identical to SEQ ID NO: 11594
  source 1..203: mol_type = other DNA

SEQ ID NO: 32165 - DNA, 203 bp, Homo sapiens; identical to SEQ ID NO: 11596
  source 1..203: mol_type = other DNA

SEQ ID NO: 32166 - DNA, 203 bp, Homo sapiens; identical to SEQ ID NO: 11597
  source 1..203: mol_type = other DNA

SEQ ID NO: 32167 - DNA, 203 bp, Homo sapiens; identical to SEQ ID NO: 11601
  source 1..203: mol_type = other DNA

SEQ ID NO: 32168 - DNA, 203 bp, Homo sapiens; identical to SEQ ID NO: 11602
  source 1..203: mol_type = other DNA

SEQ ID NO: 32169 - DNA, 203 bp, Homo sapiens; identical to SEQ ID NO: 11603
  source 1..203: mol_type = other DNA

SEQ ID NO: 32170 - DNA, 203 bp, Homo sapiens; identical to SEQ ID NO: 11604
  source 1..203: mol_type = other DNA

SEQ ID NO: 32171 - DNA, 203 bp, Homo sapiens; identical to SEQ ID NO: 11605
  source 1..203: mol_type = other DNA

SEQ ID NO: 32172 - DNA, 203 bp, Homo sapiens; identical to SEQ ID NO: 11606
  source 1..203: mol_type = other DNA

SEQ ID NO: 32173 - DNA, 203 bp, Homo sapiens; identical to SEQ ID NO: 11609
  source 1..203: mol_type = other DNA

SEQ ID NO: 32174 - DNA, 203 bp, Homo sapiens; identical to SEQ ID NO: 11630
  source 1..203: mol_type = other DNA

SEQ ID NO: 32175 - DNA, 203 bp, Homo sapiens; identical to SEQ ID NO: 11656
  source 1..203: mol_type = other DNA

SEQ ID NO: 32176 - DNA, 203 bp, Homo sapiens; identical to SEQ ID NO: 11661
  source 1..203: mol_type = other DNA

SEQ ID NO: 32177 - DNA, 203 bp, Homo sapiens; identical to SEQ ID NO: 11662
  source 1..203: mol_type = other DNA

SEQ ID NO: 32178 - DNA, 203 bp, Homo sapiens; identical to SEQ ID NO: 11663
  source 1..203: mol_type = other DNA

SEQ ID NO: 32179 - DNA, 203 bp, Homo sapiens; identical to SEQ ID NO: 11696
  source 1..203: mol_type = other DNA

SEQ ID NO: 32180 - DNA, 203 bp, Homo sapiens; identical to SEQ ID NO: 11706
  source 1..203: mol_type = other DNA

SEQ ID NO: 32181 - DNA, 203 bp, Homo sapiens; identical to SEQ ID NO: 11707
  source 1..203: mol_type = other DNA

SEQ ID NO: 32182 - DNA, 203 bp, Homo sapiens; identical to SEQ ID NO: 11708
  source 1..203: mol_type = other DNA

SEQ ID NO: 32183 - DNA, 203 bp, Homo sapiens; identical to SEQ ID NO: 11709
  source 1..203: mol_type = other DNA

SEQ ID NO: 32184 - DNA, 203 bp, Homo sapiens; identical to SEQ ID NO: 11711
  source 1..203: mol_type = other DNA

SEQ ID NO: 32185 - DNA, 203 bp, Homo sapiens; identical to SEQ ID NO: 11712
  source 1..203: mol_type = other DNA

SEQ ID NO: 32186 - DNA, 203 bp, Homo sapiens; identical to SEQ ID NO: 11719
  source 1..203: mol_type = other DNA

SEQ ID NO: 32187 - DNA, 203 bp, Homo sapiens; identical to SEQ ID NO: 11727
  source 1..203: mol_type = other DNA

SEQ ID NO: 32188 - DNA, 203 bp, Homo sapiens; identical to SEQ ID NO: 11731
  source 1..203: mol_type = other DNA

SEQ ID NO: 32189 - DNA, 203 bp, Homo sapiens; identical to SEQ ID NO: 11751
  source 1..203: mol_type = other DNA

SEQ ID NO: 32190 - DNA, 203 bp, Homo sapiens; identical to SEQ ID NO: 11765
  source 1..203: mol_type = other DNA

SEQ ID NO: 32191 - DNA, 203 bp, Homo sapiens; identical to SEQ ID NO: 11767
  source 1..203: mol_type = other DNA

SEQ ID NO: 32192 - DNA, 203 bp, Homo sapiens; identical to SEQ ID NO: 11768
  source 1..203: mol_type = other DNA

SEQ ID NO: 32193 - DNA, 203 bp, Homo sapiens; identical to SEQ ID NO: 11769
  source 1..203: mol_type = other DNA

SEQ ID NO: 32194 - DNA, 203 bp, Homo sapiens; identical to SEQ ID NO: 11772
  source 1..203: mol_type = other DNA

SEQ ID NO: 32195 - DNA, 203 bp, Homo sapiens; identical to SEQ ID NO: 11773
  source 1..203: mol_type = other DNA

SEQ ID NO: 32196 - DNA, 203 bp, Homo sapiens; identical to SEQ ID NO: 11774
  source 1..203: mol_type = other DNA

SEQ ID NO: 32197 - DNA, 203 bp, Homo sapiens; identical to SEQ ID NO: 11782
  source 1..203: mol_type = other DNA

SEQ ID NO: 32198 - DNA, 203 bp, Homo sapiens; identical to SEQ ID NO: 11791
  source 1..203: mol_type = other DNA

SEQ ID NO: 32199 - DNA, 203 bp, Homo sapiens; identical to SEQ ID NO: 11812
  source 1..203: mol_type = other DNA

SEQ ID NO: 32200 - DNA, 203 bp, Homo sapiens; identical to SEQ ID NO: 11813
  source 1..203: mol_type = other DNA

SEQ ID NO: 32201 - DNA, 203 bp, Homo sapiens; identical to SEQ ID NO: 11814
  source 1..203: mol_type = other DNA

SEQ ID NO: 32202 - DNA, 203 bp, Homo sapiens; identical to SEQ ID NO: 11815
  source 1..203: mol_type = other DNA

SEQ ID NO: 32203 - DNA, 203 bp, Homo sapiens; identical to SEQ ID NO: 11816
  source 1..203: mol_type = other DNA

SEQ ID NO: 32204 - DNA, 203 bp, Homo sapiens; identical to SEQ ID NO: 11817
  source 1..203: mol_type = other DNA

SEQ ID NO: 32205 - DNA, 203 bp, Homo sapiens; identical to SEQ ID NO: 11831
  source 1..203: mol_type = other DNA

SEQ ID NO: 32206 - DNA, 203 bp, Homo sapiens; identical to SEQ ID NO: 11838
  source 1..203: mol_type = other DNA

SEQ ID NO: 32207 - DNA, 203 bp, Homo sapiens; identical to SEQ ID NO: 11839
  source 1..203: mol_type = other DNA

SEQ ID NO: 32208 - DNA, 203 bp, Homo sapiens; identical to SEQ ID NO: 11841
  source 1..203: mol_type = other DNA

SEQ ID NO: 32209 - DNA, 203 bp, Homo sapiens; identical to SEQ ID NO: 11842
  source 1..203: mol_type = other DNA

SEQ ID NO: 32210 - DNA, 203 bp, Homo sapiens; identical to SEQ ID NO: 11863
  source 1..203: mol_type = other DNA

SEQ ID NO: 32211 - DNA, 203 bp, Homo sapiens; identical to SEQ ID NO: 11866
  source 1..203: mol_type = other DNA

SEQ ID NO: 32212 - DNA, 203 bp, Homo sapiens; identical to SEQ ID NO: 11867
  source 1..203: mol_type = other DNA

SEQ ID NO: 32213 - DNA, 203 bp, Homo sapiens; identical to SEQ ID NO: 11868
  source 1..203: mol_type = other DNA

SEQ ID NO: 32214 - DNA, 203 bp, Homo sapiens; identical to SEQ ID NO: 11869
  source 1..203: mol_type = other DNA

SEQ ID NO: 32215 - DNA, 203 bp, Homo sapiens; identical to SEQ ID NO: 11870
  source 1..203: mol_type = other DNA

SEQ ID NO: 32216 - DNA, 203 bp, Homo sapiens; identical to SEQ ID NO: 11871
  source 1..203: mol_type = other DNA

SEQ ID NO: 32217 - DNA, 203 bp, Homo sapiens; identical to SEQ ID NO: 11885
  source 1..203: mol_type = other DNA

SEQ ID NO: 32218 - DNA, 203 bp, Homo sapiens; identical to SEQ ID NO: 11886
  source 1..203: mol_type = other DNA

SEQ ID NO: 32219 - DNA, 203 bp, Homo sapiens; identical to SEQ ID NO: 11887
  source 1..203: mol_type = other DNA

SEQ ID NO: 32220 - DNA, 203 bp, Homo sapiens; identical to SEQ ID NO: 11889
  source 1..203: mol_type = other DNA

SEQ ID NO: 32221 - DNA, 203 bp, Homo sapiens; identical to SEQ ID NO: 11891
  source 1..203: mol_type = other DNA

SEQ ID NO: 32222 - DNA, 203 bp, Homo sapiens; identical to SEQ ID NO: 11902
  source 1..203: mol_type = other DNA

SEQ ID NO: 32223 - DNA, 203 bp, Homo sapiens; identical to SEQ ID NO: 11904
  source 1..203: mol_type = other DNA

SEQ ID NO: 32224 - DNA, 203 bp, Homo sapiens; identical to SEQ ID NO: 11905
  source 1..203: mol_type = other DNA

SEQ ID NO: 32225 - DNA, 203 bp, Homo sapiens; identical to SEQ ID NO: 11906
  source 1..203: mol_type = other DNA

SEQ ID NO: 32226 - DNA, 203 bp, Homo sapiens; identical to SEQ ID NO: 11907
  source 1..203: mol_type = other DNA

SEQ ID NO: 32227 - DNA, 203 bp, Homo sapiens; identical to SEQ ID NO: 11909
  source 1..203: mol_type = other DNA

SEQ ID NO: 32228 - DNA, 203 bp, Homo sapiens; identical to SEQ ID NO: 11910
  source 1..203: mol_type = other DNA

SEQ ID NO: 32229 - DNA, 203 bp, Homo sapiens; identical to SEQ ID NO: 11911
  source 1..203: mol_type = other DNA

SEQ ID NO: 32230 - DNA, 203 bp, Homo sapiens; identical to SEQ ID NO: 11912
  source 1..203: mol_type = other DNA

SEQ ID NO: 32231 - DNA, 203 bp, Homo sapiens; identical to SEQ ID NO: 11914
  source 1..203: mol_type = other DNA

SEQ ID NO: 32232 - DNA, 203 bp, Homo sapiens; identical to SEQ ID NO: 11921
  source 1..203: mol_type = other DNA

SEQ ID NO: 32233 - DNA, 203 bp, Homo sapiens; identical to SEQ ID NO: 11922
  source 1..203: mol_type = other DNA

SEQ ID NO: 32234 - DNA, 203 bp, Homo sapiens; identical to SEQ ID NO: 11923
  source 1..203: mol_type = other DNA

SEQ ID NO: 32235 - DNA, 203 bp, Homo sapiens; identical to SEQ ID NO: 11925
  source 1..203: mol_type = other DNA

SEQ ID NO: 32236 - DNA, 203 bp, Homo sapiens; identical to SEQ ID NO: 11926
  source 1..203: mol_type = other DNA

SEQ ID NO: 32237 - DNA, 203 bp, Homo sapiens; identical to SEQ ID NO: 11927
  source 1..203: mol_type = other DNA

SEQ ID NO: 32238 - DNA, 203 bp, Homo sapiens; identical to SEQ ID NO: 11956
  source 1..203: mol_type = other DNA

SEQ ID NO: 32239 - DNA, 203 bp, Homo sapiens; identical to SEQ ID NO: 11957
  source 1..203: mol_type = other DNA

SEQ ID NO: 32240 - DNA, 203 bp, Homo sapiens; identical to SEQ ID NO: 11958
  source 1..203: mol_type = other DNA

SEQ ID NO: 32241 - DNA, 203 bp, Homo sapiens; identical to SEQ ID NO: 11964
  source 1..203: mol_type = other DNA

SEQ ID NO: 32242 - DNA, 203 bp, Homo sapiens; identical to SEQ ID NO: 11992
  source 1..203: mol_type = other DNA

SEQ ID NO: 32243 - DNA, 203 bp, Homo sapiens; identical to SEQ ID NO: 11994
  source 1..203: mol_type = other DNA

SEQ ID NO: 32244 - DNA, 203 bp, Homo sapiens; identical to SEQ ID NO: 11995
  source 1..203: mol_type = other DNA

SEQ ID NO: 32245 - DNA, 203 bp, Homo sapiens; identical to SEQ ID NO: 11996
  source 1..203: mol_type = other DNA

SEQ ID NO: 32246 - DNA, 203 bp, Homo sapiens; identical to SEQ ID NO: 11997
  source 1..203: mol_type = other DNA

SEQ ID NO: 32247 - DNA, 203 bp, Homo sapiens; identical to SEQ ID NO: 11998
  source 1..203: mol_type = other DNA

SEQ ID NO: 32248 - DNA, 203 bp, Homo sapiens; identical to SEQ ID NO: 12000
  source 1..203: mol_type = other DNA

SEQ ID NO: 32249 - DNA, 203 bp, Homo sapiens; identical to SEQ ID NO: 12001
  source 1..203: mol_type = other DNA

SEQ ID NO: 32250 - DNA, 203 bp, Homo sapiens; identical to SEQ ID NO: 12012
  source 1..203: mol_type = other DNA

SEQ ID NO: 32251 - DNA, 203 bp, Homo sapiens; identical to SEQ ID NO: 12018
  source 1..203: mol_type = other DNA

SEQ ID NO: 32252 - DNA, 203 bp, Homo sapiens; identical to SEQ ID NO: 12021
  source 1..203: mol_type = other DNA

SEQ ID NO: 32253 - DNA, 203 bp, Homo sapiens; identical to SEQ ID NO: 12022
  source 1..203: mol_type = other DNA

SEQ ID NO: 32254 - DNA, 203 bp, Homo sapiens; identical to SEQ ID NO: 12023
  source 1..203: mol_type = other DNA

SEQ ID NO: 32255 - DNA, 203 bp, Homo sapiens; identical to SEQ ID NO: 12024
  source 1..203: mol_type = other DNA

SEQ ID NO: 32256 - DNA, 203 bp, Homo sapiens; identical to SEQ ID NO: 12025
  source 1..203: mol_type = other DNA

SEQ ID NO: 32257 - DNA, 203 bp, Homo sapiens; identical to SEQ ID NO: 12044
  source 1..203: mol_type = other DNA

SEQ ID NO: 32258 - DNA, 203 bp, Homo sapiens; identical to SEQ ID NO: 12067
  source 1..203: mol_type = other DNA

SEQ ID NO: 32259 - DNA, 203 bp, Homo sapiens; identical to SEQ ID NO: 12069
  source 1..203: mol_type = other DNA

SEQ ID NO: 32260 - DNA, 203 bp, Homo sapiens; identical to SEQ ID NO: 12070
  source 1..203: mol_type = other DNA

SEQ ID NO: 32261 - DNA, 203 bp, Homo sapiens; identical to SEQ ID NO: 12071
  source 1..203: mol_type = other DNA

SEQ ID NO: 32262 - DNA, 203 bp, Homo sapiens; identical to SEQ ID NO: 12078
  source 1..203: mol_type = other DNA

SEQ ID NO: 32263 - DNA, 203 bp, Homo sapiens; identical to SEQ ID NO: 12079
  source 1..203: mol_type = other DNA

SEQ ID NO: 32264 - DNA, 203 bp, Homo sapiens; identical to SEQ ID NO: 12081
  source 1..203: mol_type = other DNA

SEQ ID NO: 32265 - DNA, 203 bp, Homo sapiens; identical to SEQ ID NO: 12082
  source 1..203: mol_type = other DNA

SEQ ID NO: 32266 - DNA, 203 bp, Homo sapiens; identical to SEQ ID NO: 12088
  source 1..203: mol_type = other DNA

SEQ ID NO: 32267 - DNA, 203 bp, Homo sapiens; identical to SEQ ID NO: 12089
  source 1..203: mol_type = other DNA

SEQ ID NO: 32268 - DNA, 203 bp, Homo sapiens; identical to SEQ ID NO: 12091
  source 1..203: mol_type = other DNA

SEQ ID NO: 32269 - DNA, 203 bp, Homo sapiens; identical to SEQ ID NO: 12097
  source 1..203: mol_type = other DNA

SEQ ID NO: 32270 - DNA, 203 bp, Homo sapiens; identical to SEQ ID NO: 12099
  source 1..203: mol_type = other DNA

SEQ ID NO: 32271 - DNA, 203 bp, Homo sapiens; identical to SEQ ID NO: 12154
  source 1..203: mol_type = other DNA

SEQ ID NO: 32272 - DNA, 203 bp, Homo sapiens; identical to SEQ ID NO: 12181
  source 1..203: mol_type = other DNA

SEQ ID NO: 32273 - DNA, 203 bp, Homo sapiens; identical to SEQ ID NO: 12183
  source 1..203: mol_type = other DNA

SEQ ID NO: 32274 - DNA, 203 bp, Homo sapiens; identical to SEQ ID NO: 12184
  source 1..203: mol_type = other DNA

SEQ ID NO: 32275 - DNA, 203 bp, Homo sapiens; identical to SEQ ID NO: 12185
  source 1..203: mol_type = other DNA

SEQ ID NO: 32276 - DNA, 203 bp, Homo sapiens; identical to SEQ ID NO: 12186
  source 1..203: mol_type = other DNA

SEQ ID NO: 32277 - DNA, 203 bp, Homo sapiens; identical to SEQ ID NO: 12196
  source 1..203: mol_type = other DNA

SEQ ID NO: 32278 - DNA, 203 bp, Homo sapiens; identical to SEQ ID NO: 12197
  source 1..203: mol_type = other DNA

SEQ ID NO: 32279 - DNA, 203 bp, Homo sapiens; identical to SEQ ID NO: 12207
  source 1..203: mol_type = other DNA

SEQ ID NO: 32280 - DNA, 203 bp, Homo sapiens; identical to SEQ ID NO: 12210
  source 1..203: mol_type = other DNA

SEQ ID NO: 32281 - DNA, 203 bp, Homo sapiens; identical to SEQ ID NO: 12211
  source 1..203: mol_type = other DNA

SEQ ID NO: 32282 - DNA, 203 bp, Homo sapiens; identical to SEQ ID NO: 12212
  source 1..203: mol_type = other DNA

SEQ ID NO: 32283 - DNA, 203 bp, Homo sapiens; identical to SEQ ID NO: 12213
  source 1..203: mol_type = other DNA

SEQ ID NO: 32284 - DNA, 203 bp, Homo sapiens; identical to SEQ ID NO: 12215
  source 1..203: mol_type = other DNA

SEQ ID NO: 32285 - DNA, 203 bp, Homo sapiens; identical to SEQ ID NO: 12217
  source 1..203: mol_type = other DNA

SEQ ID NO: 32286 - DNA, 203 bp, Homo sapiens; identical to SEQ ID NO: 12220
  source 1..203: mol_type = other DNA

SEQ ID NO: 32287 - DNA, 203 bp, Homo sapiens; identical to SEQ ID NO: 12221
  source 1..203: mol_type = other DNA

SEQ ID NO: 32288 - DNA, 203 bp, Homo sapiens; identical to SEQ ID NO: 12222
  source 1..203: mol_type = other DNA

SEQ ID NO: 32289 - DNA, 203 bp, Homo sapiens; identical to SEQ ID NO: 12224
  source 1..203: mol_type = other DNA

SEQ ID NO: 32290 - DNA, 203 bp, Homo sapiens; identical to SEQ ID NO: 12225
  source 1..203: mol_type = other DNA

SEQ ID NO: 32291 - DNA, 203 bp, Homo sapiens; identical to SEQ ID NO: 12226
  source 1..203: mol_type = other DNA

SEQ ID NO: 32292 - DNA, 203 bp, Homo sapiens; identical to SEQ ID NO: 12227
  source 1..203: mol_type = other DNA

SEQ ID NO: 32293 - DNA, 203 bp, Homo sapiens; identical to SEQ ID NO: 12232
  source 1..203: mol_type = other DNA

SEQ ID NO: 32294 - DNA, 203 bp, Homo sapiens; identical to SEQ ID NO: 12233
  source 1..203: mol_type = other DNA

SEQ ID NO: 32295 - DNA, 203 bp, Homo sapiens; identical to SEQ ID NO: 12235
  source 1..203: mol_type = other DNA

SEQ ID NO: 32296 - DNA, 203 bp, Homo sapiens; identical to SEQ ID NO: 12236
  source 1..203: mol_type = other DNA

SEQ ID NO: 32297 - DNA, 203 bp, Homo sapiens; identical to SEQ ID NO: 12273
  source 1..203: mol_type = other DNA

SEQ ID NO: 32298 - DNA, 203 bp, Homo sapiens; identical to SEQ ID NO: 12280
  source 1..203: mol_type = other DNA

SEQ ID NO: 32299 - DNA, 203 bp, Homo sapiens; identical to SEQ ID NO: 12281
  source 1..203: mol_type = other DNA

SEQ ID NO: 32300 - DNA, 203 bp, Homo sapiens; identical to SEQ ID NO: 12282
  source 1..203: mol_type = other DNA

SEQ ID NO: 32301 - DNA, 203 bp, Homo sapiens; identical to SEQ ID NO: 12283
  source 1..203: mol_type = other DNA

SEQ ID NO: 32302 - DNA, 203 bp, Homo sapiens; identical to SEQ ID NO: 12294
  source 1..203: mol_type = other DNA

SEQ ID NO: 32303 - DNA, 203 bp, Homo sapiens; identical to SEQ ID NO: 12295
  source 1..203: mol_type = other DNA

SEQ ID NO: 32304 - DNA, 203 bp, Homo sapiens; identical to SEQ ID NO: 12306
  source 1..203: mol_type = other DNA

SEQ ID NO: 32305 - DNA, 203 bp, Homo sapiens; identical to SEQ ID NO: 12307
  source 1..203: mol_type = other DNA

SEQ ID NO: 32306 - DNA, 203 bp, Homo sapiens; identical to SEQ ID NO: 12309
  source 1..203: mol_type = other DNA

SEQ ID NO: 32307 - DNA, 203 bp, Homo sapiens; identical to SEQ ID NO: 12310
  source 1..203: mol_type = other DNA

SEQ ID NO: 32308 - DNA, 203 bp, Homo sapiens; identical to SEQ ID NO: 12312
  source 1..203: mol_type = other DNA

SEQ ID NO: 32309 - DNA, 203 bp, Homo sapiens; identical to SEQ ID NO: 12331
  source 1..203: mol_type = other DNA

SEQ ID NO: 32310 - DNA, 203 bp, Homo sapiens; identical to SEQ ID NO: 12333
  source 1..203: mol_type = other DNA

SEQ ID NO: 32311 - DNA, 203 bp, Homo sapiens; identical to SEQ ID NO: 12345
  source 1..203: mol_type = other DNA

SEQ ID NO: 32312 - DNA, 203 bp, Homo sapiens; identical to SEQ ID NO: 12346
  source 1..203: mol_type = other DNA

SEQ ID NO: 32313 - DNA, 203 bp, Homo sapiens; identical to SEQ ID NO: 12353
  source 1..203: mol_type = other DNA

SEQ ID NO: 32314 - DNA, 203 bp, Homo sapiens; identical to SEQ ID NO: 12354
  source 1..203: mol_type = other DNA

SEQ ID NO: 32315 - DNA, 203 bp, Homo sapiens; identical to SEQ ID NO: 12366
  source 1..203: mol_type = other DNA

SEQ ID NO: 32316 - DNA, 203 bp, Homo sapiens; identical to SEQ ID NO: 12371
  source 1..203: mol_type = other DNA

SEQ ID NO: 32317 - DNA, 203 bp, Homo sapiens; identical to SEQ ID NO: 12382
  source 1..203: mol_type = other DNA

SEQ ID NO: 32318 - DNA, 203 bp, Homo sapiens; identical to SEQ ID NO: 12390
  source 1..203: mol_type = other DNA

SEQ ID NO: 32319 - DNA, 203 bp, Homo sapiens; identical to SEQ ID NO: 12395
  source 1..203: mol_type = other DNA

SEQ ID NO: 32320 - DNA, 203 bp, Homo sapiens; identical to SEQ ID NO: 12398
  source 1..203: mol_type = other DNA

SEQ ID NO: 32321 - DNA, 203 bp, Homo sapiens; identical to SEQ ID NO: 12404
  source 1..203: mol_type = other DNA

SEQ ID NO: 32322 - DNA, 203 bp, Homo sapiens; identical to SEQ ID NO: 12406
  source 1..203: mol_type = other DNA

SEQ ID NO: 32323 - DNA, 203 bp, Homo sapiens; identical to SEQ ID NO: 12409
  source 1..203: mol_type = other DNA

SEQ ID NO: 32324 - DNA, 203 bp, Homo sapiens; identical to SEQ ID NO: 12410
  source 1..203: mol_type = other DNA

SEQ ID NO: 32325 - DNA, 203 bp, Homo sapiens; identical to SEQ ID NO: 12411
  source 1..203: mol_type = other DNA

SEQ ID NO: 32326 - DNA, 203 bp, Homo sapiens; identical to SEQ ID NO: 12421
  source 1..203: mol_type = other DNA

SEQ ID NO: 32327 - DNA, 203 bp, Homo sapiens; identical to SEQ ID NO: 12422
  source 1..203: mol_type = other DNA

SEQ ID NO: 32328 - DNA, 203 bp, Homo sapiens; identical to SEQ ID NO: 12423
  source 1..203: mol_type = other DNA

SEQ ID NO: 32329 - DNA, 203 bp, Homo sapiens; identical to SEQ ID NO: 12425
  source 1..203: mol_type = other DNA

SEQ ID NO: 32330 - DNA, 203 bp, Homo sapiens; identical to SEQ ID NO: 12426
  source 1..203: mol_type = other DNA

SEQ ID NO: 32331 - DNA, 203 bp, Homo sapiens; identical to SEQ ID NO: 12427
  source 1..203: mol_type = other DNA

SEQ ID NO: 32332 - DNA, 203 bp, Homo sapiens; identical to SEQ ID NO: 12428
  source 1..203: mol_type = other DNA

SEQ ID NO: 32333 - DNA, 203 bp, Homo sapiens; identical to SEQ ID NO: 12453
  source 1..203: mol_type = other DNA

SEQ ID NO: 32334 - DNA, 203 bp, Homo sapiens; identical to SEQ ID NO: 12454
  source 1..203: mol_type = other DNA

SEQ ID NO: 32335 - DNA, 203 bp, Homo sapiens; identical to SEQ ID NO: 12466
  source 1..203: mol_type = other DNA

SEQ ID NO: 32336 - DNA, 203 bp, Homo sapiens; identical to SEQ ID NO: 12467
  source 1..203: mol_type = other DNA

SEQ ID NO: 32337 - DNA, 203 bp, Homo sapiens; identical to SEQ ID NO: 12468
  source 1..203: mol_type = other DNA

SEQ ID NO: 32338 - DNA, 203 bp, Homo sapiens; identical to SEQ ID NO: 12469
  source 1..203: mol_type = other DNA

SEQ ID NO: 32339 - DNA, 203 bp, Homo sapiens; identical to SEQ ID NO: 12470
  source 1..203: mol_type = other DNA

SEQ ID NO: 32340 - DNA, 203 bp, Homo sapiens; identical to SEQ ID NO: 12473
  source 1..203: mol_type = other DNA

SEQ ID NO: 32341 - DNA, 203 bp, Homo sapiens; identical to SEQ ID NO: 12474
  source 1..203: mol_type = other DNA

SEQ ID NO: 32342 - DNA, 203 bp, Homo sapiens; identical to SEQ ID NO: 12486
  source 1..203: mol_type = other DNA

SEQ ID NO: 32343 - DNA, 203 bp, Homo sapiens; identical to SEQ ID NO: 12496
  source 1..203: mol_type = other DNA

SEQ ID NO: 32344 - DNA, 203 bp, Homo sapiens; identical to SEQ ID NO: 12497
  source 1..203: mol_type = other DNA

SEQ ID NO: 32345 - DNA, 203 bp, Homo sapiens; identical to SEQ ID NO: 12499
  source 1..203: mol_type = other DNA

SEQ ID NO: 32346 - DNA, 203 bp, Homo sapiens; identical to SEQ ID NO: 12500
  source 1..203: mol_type = other DNA

SEQ ID NO: 32347 - DNA, 203 bp, Homo sapiens; identical to SEQ ID NO: 12518
  source 1..203: mol_type = other DNA

SEQ ID NO: 32348 - DNA, 203 bp, Homo sapiens; identical to SEQ ID NO: 12519
  source 1..203: mol_type = other DNA

SEQ ID NO: 32349 - DNA, 203 bp, Homo sapiens; identical to SEQ ID NO: 12520
  source 1..203: mol_type = other DNA

SEQ ID NO: 32350 - DNA, 203 bp, Homo sapiens; identical to SEQ ID NO: 12521
  source 1..203: mol_type = other DNA

SEQ ID NO: 32351 - DNA, 203 bp, Homo sapiens; identical to SEQ ID NO: 12523
  source 1..203: mol_type = other DNA

SEQ ID NO: 32352 - DNA, 203 bp, Homo sapiens; identical to SEQ ID NO: 12524
  source 1..203: mol_type = other DNA

SEQ ID NO: 32353 - DNA, 203 bp, Homo sapiens; identical to SEQ ID NO: 12525
  source 1..203: mol_type = other DNA

SEQ ID NO: 32354 - DNA, 203 bp, Homo sapiens; identical to SEQ ID NO: 12546
  source 1..203: mol_type = other DNA

SEQ ID NO: 32355 - DNA, 203 bp, Homo sapiens; identical to SEQ ID NO: 12548
  source 1..203: mol_type = other DNA

SEQ ID NO: 32356 - DNA, 203 bp, Homo sapiens; identical to SEQ ID NO: 12549
  source 1..203: mol_type = other DNA

SEQ ID NO: 32357 - DNA, 203 bp, Homo sapiens; identical to SEQ ID NO: 12550
  source 1..203: mol_type = other DNA

SEQ ID NO: 32358 - DNA, 203 bp, Homo sapiens; identical to SEQ ID NO: 12551
  source 1..203: mol_type = other DNA

SEQ ID NO: 32359 - DNA, 203 bp, Homo sapiens; identical to SEQ ID NO: 12593
  source 1..203: mol_type = other DNA

SEQ ID NO: 32360 - DNA, 203 bp, Homo sapiens; identical to SEQ ID NO: 12594
  source 1..203: mol_type = other DNA

SEQ ID NO: 32361 - DNA, 203 bp, Homo sapiens; identical to SEQ ID NO: 12601
  source 1..203: mol_type = other DNA

SEQ ID NO: 32362 - DNA, 203 bp, Homo sapiens; identical to SEQ ID NO: 12624
  source 1..203: mol_type = other DNA

SEQ ID NO: 32363 - DNA, 203 bp, Homo sapiens; identical to SEQ ID NO: 12626
  source 1..203: mol_type = other DNA

SEQ ID NO: 32364 - DNA, 203 bp, Homo sapiens; identical to SEQ ID NO: 12627
  source 1..203: mol_type = other DNA

SEQ ID NO: 32365 - DNA, 203 bp, Homo sapiens; identical to SEQ ID NO: 12628
  source 1..203: mol_type = other DNA

SEQ ID NO: 32366 - DNA, 203 bp, Homo sapiens; identical to SEQ ID NO: 12630
  source 1..203: mol_type = other DNA

SEQ ID NO: 32367 - DNA, 203 bp, Homo sapiens; identical to SEQ ID NO: 12631
  source 1..203: mol_type = other DNA

SEQ ID NO: 32368 - DNA, 203 bp, Homo sapiens; identical to SEQ ID NO: 12632
  source 1..203: mol_type = other DNA

SEQ ID NO: 32369 - DNA, 203 bp, Homo sapiens; identical to SEQ ID NO: 12634
  source 1..203: mol_type = other DNA

SEQ ID NO: 32370 - DNA, 203 bp, Homo sapiens; identical to SEQ ID NO: 12635
  source 1..203: mol_type = other DNA

SEQ ID NO: 32371 - DNA, 203 bp, Homo sapiens; identical to SEQ ID NO: 12637
  source 1..203: mol_type = other DNA

SEQ ID NO: 32372 - DNA, 203 bp, Homo sapiens; identical to SEQ ID NO: 12638
  source 1..203: mol_type = other DNA

SEQ ID NO: 32373 - DNA, 203 bp, Homo sapiens; identical to SEQ ID NO: 12640
  source 1..203: mol_type = other DNA

SEQ ID NO: 32374 - DNA, 203 bp, Homo sapiens; identical to SEQ ID NO: 12641
  source 1..203: mol_type = other DNA

SEQ ID NO: 32375 - DNA, 203 bp, Homo sapiens; identical to SEQ ID NO: 12643
  source 1..203: mol_type = other DNA

SEQ ID NO: 32376 - DNA, 203 bp, Homo sapiens; identical to SEQ ID NO: 12644
  source 1..203: mol_type = other DNA

SEQ ID NO: 32377 - DNA, 203 bp, Homo sapiens; identical to SEQ ID NO: 12645
  source 1..203: mol_type = other DNA

SEQ ID NO: 32378 - DNA, 203 bp, Homo sapiens; identical to SEQ ID NO: 12646
  source 1..203: mol_type = other DNA

SEQ ID NO: 32379 - DNA, 203 bp, Homo sapiens; identical to SEQ ID NO: 12675
  source 1..203: mol_type = other DNA

SEQ ID NO: 32380 - DNA, 203 bp, Homo sapiens; identical to SEQ ID NO: 12677
  source 1..203: mol_type = other DNA

SEQ ID NO: 32381 - DNA, 203 bp, Homo sapiens; identical to SEQ ID NO: 12678
  source 1..203: mol_type = other DNA

SEQ ID NO: 32382 - DNA, 203 bp, Homo sapiens; identical to SEQ ID NO: 12679
  source 1..203: mol_type = other DNA

SEQ ID NO: 32383 - DNA, 203 bp, Homo sapiens; identical to SEQ ID NO: 12689
  source 1..203: mol_type = other DNA

SEQ ID NO: 32384 - DNA, 203 bp, Homo sapiens; identical to SEQ ID NO: 12690
  source 1..203: mol_type = other DNA

SEQ ID NO: 32385 - DNA, 203 bp, Homo sapiens; identical to SEQ ID NO: 12691
  source 1..203: mol_type = other DNA

SEQ ID NO: 32386 - DNA, 203 bp, Homo sapiens; identical to SEQ ID NO: 12702
  source 1..203: mol_type = other DNA

SEQ ID NO: 32387 - DNA, 203 bp, Homo sapiens; identical to SEQ ID NO: 12703
  source 1..203: mol_type = other DNA

SEQ ID NO: 32388 - DNA, 203 bp, Homo sapiens; identical to SEQ ID NO: 12705
  source 1..203: mol_type = other DNA

SEQ ID NO: 32389 - DNA, 203 bp, Homo sapiens; identical to SEQ ID NO: 12707
  source 1..203: mol_type = other DNA

SEQ ID NO: 32390 - DNA, 203 bp, Homo sapiens; identical to SEQ ID NO: 12708
  source 1..203: mol_type = other DNA

SEQ ID NO: 32391 - DNA, 203 bp, Homo sapiens; identical to SEQ ID NO: 12709
  source 1..203: mol_type = other DNA

SEQ ID NO: 32392 - DNA, 203 bp, Homo sapiens; identical to SEQ ID NO: 12725
  source 1..203: mol_type = other DNA

SEQ ID NO: 32393 - DNA, 203 bp, Homo sapiens; identical to SEQ ID NO: 12726
  source 1..203: mol_type = other DNA

SEQ ID NO: 32394 - DNA, 203 bp, Homo sapiens; identical to SEQ ID NO: 12727
  source 1..203: mol_type = other DNA

SEQ ID NO: 32395 - DNA, 203 bp, Homo sapiens; identical to SEQ ID NO: 12737
  source 1..203: mol_type = other DNA

SEQ ID NO: 32396 - DNA, 203 bp, Homo sapiens; identical to SEQ ID NO: 12739
  source 1..203: mol_type = other DNA

SEQ ID NO: 32397 - DNA, 203 bp, Homo sapiens; identical to SEQ ID NO: 12740
  source 1..203: mol_type = other DNA

SEQ ID NO: 32398 - DNA, 203 bp, Homo sapiens; identical to SEQ ID NO: 12741
  source 1..203: mol_type = other DNA

SEQ ID NO: 32399 - DNA, 203 bp, Homo sapiens; identical to SEQ ID NO: 12744
  source 1..203: mol_type = other DNA

SEQ ID NO: 32400 - DNA, 203 bp, Homo sapiens; identical to SEQ ID NO: 12758
  source 1..203: mol_type = other DNA

SEQ ID NO: 32401 - DNA, 203 bp, Homo sapiens; identical to SEQ ID NO: 12759
  source 1..203: mol_type = other DNA

SEQ ID NO: 32402 - DNA, 203 bp, Homo sapiens; identical to SEQ ID NO: 12762
  source 1..203: mol_type = other DNA

SEQ ID NO: 32403 - DNA, 203 bp, Homo sapiens; identical to SEQ ID NO: 12781
  source 1..203: mol_type = other DNA

SEQ ID NO: 32404 - DNA, 203 bp, Homo sapiens; identical to SEQ ID NO: 12782
  source 1..203: mol_type = other DNA

SEQ ID NO: 32405 - DNA, 203 bp, Homo sapiens; identical to SEQ ID NO: 12783
  source 1..203: mol_type = other DNA

SEQ ID NO: 32406 - DNA, 203 bp, Homo sapiens; identical to SEQ ID NO: 12785
  source 1..203: mol_type = other DNA

SEQ ID NO: 32407 - DNA, 203 bp, Homo sapiens; identical to SEQ ID NO: 12802
  source 1..203: mol_type = other DNA

SEQ ID NO: 32408 - DNA, 203 bp, Homo sapiens; identical to SEQ ID NO: 12803
  source 1..203: mol_type = other DNA

SEQ ID NO: 32409 - DNA, 203 bp, Homo sapiens; identical to SEQ ID NO: 12804
  source 1..203: mol_type = other DNA

SEQ ID NO: 32410 - DNA, 203 bp, Homo sapiens; identical to SEQ ID NO: 12806
  source 1..203: mol_type = other DNA

SEQ ID NO: 32411 - DNA, 203 bp, Homo sapiens; identical to SEQ ID NO: 12817
  source 1..203: mol_type = other DNA

SEQ ID NO: 32412 - DNA, 203 bp, Homo sapiens; identical to SEQ ID NO: 12818
  source 1..203: mol_type = other DNA

SEQ ID NO: 32413 - DNA, 203 bp, Homo sapiens; identical to SEQ ID NO: 12825
  source 1..203: mol_type = other DNA

SEQ ID NO: 32414 - DNA, 203 bp, Homo sapiens; identical to SEQ ID NO: 12847
  source 1..203: mol_type = other DNA

SEQ ID NO: 32415 - DNA, 203 bp, Homo sapiens; identical to SEQ ID NO: 12850
  source 1..203: mol_type = other DNA

SEQ ID NO: 32416 - DNA, 203 bp, Homo sapiens; identical to SEQ ID NO: 12851
  source 1..203: mol_type = other DNA

SEQ ID NO: 32417 - DNA, 203 bp, Homo sapiens; identical to SEQ ID NO: 12857
  source 1..203: mol_type = other DNA

SEQ ID NO: 32418 - DNA, 203 bp, Homo sapiens; identical to SEQ ID NO: 12858
  source 1..203: mol_type = other DNA

SEQ ID NO: 32419 - DNA, 203 bp, Homo sapiens; identical to SEQ ID NO: 12859
  source 1..203: mol_type = other DNA

SEQ ID NO: 32420 - DNA, 203 bp, Homo sapiens; identical to SEQ ID NO: 12860
  source 1..203: mol_type = other DNA

SEQ ID NO: 32421 - DNA, 203 bp, Homo sapiens; identical to SEQ ID NO: 12862
  source 1..203: mol_type = other DNA

SEQ ID NO: 32422 - DNA, 203 bp, Homo sapiens; identical to SEQ ID NO: 12863
  source 1..203: mol_type = other DNA

SEQ ID NO: 32423 - DNA, 203 bp, Homo sapiens; identical to SEQ ID NO: 12864
  source 1..203: mol_type = other DNA

SEQ ID NO: 32424 - DNA, 203 bp, Homo sapiens; identical to SEQ ID NO: 12872
  source 1..203: mol_type = other DNA

SEQ ID NO: 32425 - DNA, 203 bp, Homo sapiens; identical to SEQ ID NO: 12887
  source 1..203: mol_type = other DNA

SEQ ID NO: 32426 - DNA, 203 bp, Homo sapiens; identical to SEQ ID NO: 12894
  source 1..203: mol_type = other DNA

SEQ ID NO: 32427 - DNA, 203 bp, Homo sapiens; identical to SEQ ID NO: 12901
  source 1..203: mol_type = other DNA

SEQ ID NO: 32428 - DNA, 203 bp, Homo sapiens; identical to SEQ ID NO: 12906
  source 1..203: mol_type = other DNA

SEQ ID NO: 32429 - DNA, 203 bp, Homo sapiens; identical to SEQ ID NO: 12919
  source 1..203: mol_type = other DNA

SEQ ID NO: 32430 - DNA, 203 bp, Homo sapiens; identical to SEQ ID NO: 12940
  source 1..203: mol_type = other DNA

SEQ ID NO: 32431 - DNA, 203 bp, Homo sapiens; identical to SEQ ID NO: 12941
  source 1..203: mol_type = other DNA

SEQ ID NO: 32432 - DNA, 203 bp, Homo sapiens; identical to SEQ ID NO: 12948
  source 1..203: mol_type = other DNA

SEQ ID NO: 32433 - DNA, 203 bp, Homo sapiens; identical to SEQ ID NO: 12950
  source 1..203: mol_type = other DNA

SEQ ID NO: 32434 - DNA, 203 bp, Homo sapiens; identical to SEQ ID NO: 12951
  source 1..203: mol_type = other DNA

SEQ ID NO: 32435 - DNA, 203 bp, Homo sapiens; identical to SEQ ID NO: 12952
  source 1..203: mol_type = other DNA

SEQ ID NO: 32436 - DNA, 203 bp, Homo sapiens; identical to SEQ ID NO: 12953
  source 1..203: mol_type = other DNA

SEQ ID NO: 32437 - DNA, 203 bp, Homo sapiens; identical to SEQ ID NO: 12954
  source 1..203: mol_type = other DNA

SEQ ID NO: 32438 - DNA, 203 bp, Homo sapiens; identical to SEQ ID NO: 12955
  source 1..203: mol_type = other DNA

SEQ ID NO: 32439 - DNA, 203 bp, Homo sapiens; identical to SEQ ID NO: 12956
  source 1..203: mol_type = other DNA

SEQ ID NO: 32440 - DNA, 203 bp, Homo sapiens; identical to SEQ ID NO: 12957
  source 1..203: mol_type = other DNA

SEQ ID NO: 32441 - DNA, 203 bp, Homo sapiens; identical to SEQ ID NO: 12958
  source 1..203: mol_type = other DNA

SEQ ID NO: 32442 - DNA, 203 bp, Homo sapiens; identical to SEQ ID NO: 12959
  source 1..203: mol_type = other DNA

SEQ ID NO: 32443 - DNA, 203 bp, Homo sapiens; identical to SEQ ID NO: 12961
  source 1..203: mol_type = other DNA

SEQ ID NO: 32444 - DNA, 203 bp, Homo sapiens; identical to SEQ ID NO: 12964
  source 1..203: mol_type = other DNA

SEQ ID NO: 32445 - DNA, 203 bp, Homo sapiens; identical to SEQ ID NO: 12965
  source 1..203: mol_type = other DNA

SEQ ID NO: 32446 - DNA, 203 bp, Homo sapiens; identical to SEQ ID NO: 12968
  source 1..203: mol_type = other DNA

SEQ ID NO: 32447 - DNA, 203 bp, Homo sapiens; identical to SEQ ID NO: 12972
  source 1..203: mol_type = other DNA

SEQ ID NO: 32448 - DNA, 203 bp, Homo sapiens; identical to SEQ ID NO: 12993
  source 1..203: mol_type = other DNA

SEQ ID NO: 32449 - DNA, 203 bp, Homo sapiens; identical to SEQ ID NO: 12995
  source 1..203: mol_type = other DNA

SEQ ID NO: 32450 - DNA, 203 bp, Homo sapiens; identical to SEQ ID NO: 12996
  source 1..203: mol_type = other DNA

SEQ ID NO: 32451 - DNA, 203 bp, Homo sapiens; identical to SEQ ID NO: 12997
  source 1..203: mol_type = other DNA

SEQ ID NO: 32452 - DNA, 203 bp, Homo sapiens; identical to SEQ ID NO: 13005
  source 1..203: mol_type = other DNA

SEQ ID NO: 32453 - DNA, 203 bp, Homo sapiens; identical to SEQ ID NO: 13009
  source 1..203: mol_type = other DNA

SEQ ID NO: 32454 - DNA, 203 bp, Homo sapiens; identical to SEQ ID NO: 13010
  source 1..203: mol_type = other DNA

SEQ ID NO: 32455 - DNA, 203 bp, Homo sapiens; identical to SEQ ID NO: 13011
  source 1..203: mol_type = other DNA

SEQ ID NO: 32456 - DNA, 203 bp, Homo sapiens; identical to SEQ ID NO: 13025
  source 1..203: mol_type = other DNA

SEQ ID NO: 32457 - DNA, 203 bp, Homo sapiens; identical to SEQ ID NO: 13028
  source 1..203: mol_type = other DNA

SEQ ID NO: 32458 - DNA, 203 bp, Homo sapiens; identical to SEQ ID NO: 13029
  source 1..203: mol_type = other DNA

SEQ ID NO: 32459 - DNA, 203 bp, Homo sapiens; identical to SEQ ID NO: 13033
  source 1..203: mol_type = other DNA

SEQ ID NO: 32460 - DNA, 203 bp, Homo sapiens; identical to SEQ ID NO: 13034
  source 1..203: mol_type = other DNA

SEQ ID NO: 32461 - DNA, 203 bp, Homo sapiens; identical to SEQ ID NO: 13035
  source 1..203: mol_type = other DNA

SEQ ID NO: 32462 - DNA, 203 bp, Homo sapiens; identical to SEQ ID NO: 13036
  source 1..203: mol_type = other DNA

SEQ ID NO: 32463 - DNA, 203 bp, Homo sapiens; identical to SEQ ID NO: 13056
  source 1..203: mol_type = other DNA

SEQ ID NO: 32464 - DNA, 203 bp, Homo sapiens; identical to SEQ ID NO: 13077
  source 1..203: mol_type = other DNA

SEQ ID NO: 32465 - DNA, 203 bp, Homo sapiens; identical to SEQ ID NO: 13078
  source 1..203: mol_type = other DNA

SEQ ID NO: 32466 - DNA, 203 bp, Homo sapiens; identical to SEQ ID NO: 13083
  source 1..203: mol_type = other DNA

SEQ ID NO: 32467 - DNA, 203 bp, Homo sapiens; identical to SEQ ID NO: 13090
  source 1..203: mol_type = other DNA

SEQ ID NO: 32468 - DNA, 203 bp, Homo sapiens; identical to SEQ ID NO: 13152
  source 1..203: mol_type = other DNA

SEQ ID NO: 32469 - DNA, 203 bp, Homo sapiens; identical to SEQ ID NO: 13160
  source 1..203: mol_type = other DNA

SEQ ID NO: 32470 - DNA, 203 bp, Homo sapiens; identical to SEQ ID NO: 13173
  source 1..203: mol_type = other DNA

SEQ ID NO: 32471 - DNA, 203 bp, Homo sapiens; identical to SEQ ID NO: 13175
  source 1..203: mol_type = other DNA

SEQ ID NO: 32472 - DNA, 203 bp, Homo sapiens; identical to SEQ ID NO: 13176
  source 1..203: mol_type = other DNA

SEQ ID NO: 32473 - DNA, 203 bp, Homo sapiens; identical to SEQ ID NO: 13177
  source 1..203: mol_type = other DNA

SEQ ID NO: 32474 - DNA, 203 bp, Homo sapiens; identical to SEQ ID NO: 13178
  source 1..203: mol_type = other DNA

SEQ ID NO: 32475 - DNA, 203 bp, Homo sapiens; identical to SEQ ID NO: 13179
  source 1..203: mol_type = other DNA

SEQ ID NO: 32476 - DNA, 203 bp, Homo sapiens; identical to SEQ ID NO: 13180
  source 1..203: mol_type = other DNA

SEQ ID NO: 32477 - DNA, 203 bp, Homo sapiens; identical to SEQ ID NO: 13182
  source 1..203: mol_type = other DNA

SEQ ID NO: 32478 - DNA, 203 bp, Homo sapiens; identical to SEQ ID NO: 13183
  source 1..203: mol_type = other DNA

SEQ ID NO: 32479 - DNA, 203 bp, Homo sapiens; identical to SEQ ID NO: 13184
  source 1..203: mol_type = other DNA

SEQ ID NO: 32480 - DNA, 203 bp, Homo sapiens; identical to SEQ ID NO: 13186
  source 1..203: mol_type = other DNA

SEQ ID NO: 32481 - DNA, 203 bp, Homo sapiens; identical to SEQ ID NO: 13187
  source 1..203: mol_type = other DNA

SEQ ID NO: 32482 - DNA, 203 bp, Homo sapiens; identical to SEQ ID NO: 13188
  source 1..203: mol_type = other DNA

SEQ ID NO: 32483 - DNA, 203 bp, Homo sapiens; identical to SEQ ID NO: 13189
  source 1..203: mol_type = other DNA

SEQ ID NO: 32484 - DNA, 203 bp, Homo sapiens; identical to SEQ ID NO: 13190
  source 1..203: mol_type = other DNA

SEQ ID NO: 32485 - DNA, 203 bp, Homo sapiens; identical to SEQ ID NO: 13192
  source 1..203: mol_type = other DNA

SEQ ID NO: 32486 - DNA, 203 bp, Homo sapiens; identical to SEQ ID NO: 13207
  source 1..203: mol_type = other DNA

SEQ ID NO: 32487 - DNA, 203 bp, Homo sapiens; identical to SEQ ID NO: 13208
  source 1..203: mol_type = other DNA

SEQ ID NO: 32488 - DNA, 203 bp, Homo sapiens; identical to SEQ ID NO: 13209
  source 1..203: mol_type = other DNA

SEQ ID NO: 32489 - DNA, 203 bp, Homo sapiens; identical to SEQ ID NO: 13220
  source 1..203: mol_type = other DNA

SEQ ID NO: 32490 - DNA, 203 bp, Homo sapiens; identical to SEQ ID NO: 13222
  source 1..203: mol_type = other DNA

SEQ ID NO: 32491 - DNA, 203 bp, Homo sapiens; identical to SEQ ID NO: 13223
  source 1..203: mol_type = other DNA

SEQ ID NO: 32492 - DNA, 203 bp, Homo sapiens; identical to SEQ ID NO: 13233
  source 1..203: mol_type = other DNA

SEQ ID NO: 32493 - DNA, 203 bp, Homo sapiens; identical to SEQ ID NO: 13239
  source 1..203: mol_type = other DNA

SEQ ID NO: 32494 - DNA, 203 bp, Homo sapiens; identical to SEQ ID NO: 13241
  source 1..203: mol_type = other DNA

SEQ ID NO: 32495 - DNA, 203 bp, Homo sapiens; identical to SEQ ID NO: 13242
  source 1..203: mol_type = other DNA

SEQ ID NO: 32496 - DNA, 203 bp, Homo sapiens; identical to SEQ ID NO: 13243
  source 1..203: mol_type = other DNA

SEQ ID NO: 32497 - DNA, 203 bp, Homo sapiens; identical to SEQ ID NO: 13244
  source 1..203: mol_type = other DNA

SEQ ID NO: 32498 - DNA, 203 bp, Homo sapiens; identical to SEQ ID NO: 13246
  source 1..203: mol_type = other DNA

SEQ ID NO: 32499 - DNA, 203 bp, Homo sapiens; identical to SEQ ID NO: 13247
  source 1..203: mol_type = other DNA

SEQ ID NO: 32500 - DNA, 203 bp, Homo sapiens; identical to SEQ ID NO: 13248
  source 1..203: mol_type = other DNA

SEQ ID NO: 32501 - DNA, 203 bp, Homo sapiens; identical to SEQ ID NO: 13250
  source 1..203: mol_type = other DNA

SEQ ID NO: 32502 - DNA, 203 bp, Homo sapiens; identical to SEQ ID NO: 13252
  source 1..203: mol_type = other DNA

SEQ ID NO: 32503 - DNA, 203 bp, Homo sapiens; identical to SEQ ID NO: 13254
  source 1..203: mol_type = other DNA

SEQ ID NO: 32504 - DNA, 203 bp, Homo sapiens; identical to SEQ ID NO: 13256
  source 1..203: mol_type = other DNA

SEQ ID NO: 32505 - DNA, 203 bp, Homo sapiens; identical to SEQ ID NO: 13257
  source 1..203: mol_type = other DNA

SEQ ID NO: 32506 - DNA, 203 bp, Homo sapiens; identical to SEQ ID NO: 13261
  source 1..203: mol_type = other DNA

SEQ ID NO: 32507 - DNA, 203 bp, Homo sapiens; identical to SEQ ID NO: 13262
  source 1..203: mol_type = other DNA

SEQ ID NO: 32508 - DNA, 203 bp, Homo sapiens; identical to SEQ ID NO: 13263
  source 1..203: mol_type = other DNA

SEQ ID NO: 32509 - DNA, 203 bp, Homo sapiens; identical to SEQ ID NO: 13265
  source 1..203: mol_type = other DNA

SEQ ID NO: 32510 - DNA, 203 bp, Homo sapiens; identical to SEQ ID NO: 13269
  source 1..203: mol_type = other DNA

SEQ ID NO: 32511 - DNA, 203 bp, Homo sapiens; identical to SEQ ID NO: 13270
  source 1..203: mol_type = other DNA

SEQ ID NO: 32512 - DNA, 203 bp, Homo sapiens; identical to SEQ ID NO: 13271
  source 1..203: mol_type = other DNA

SEQ ID NO: 32513 - DNA, 203 bp, Homo sapiens; identical to SEQ ID NO: 13314
  source 1..203: mol_type = other DNA

SEQ ID NO: 32514 - DNA, 203 bp, Homo sapiens; identical to SEQ ID NO: 13323
  source 1..203: mol_type = other DNA

SEQ ID NO: 32515 - DNA, 203 bp, Homo sapiens; identical to SEQ ID NO: 13324
  source 1..203: mol_type = other DNA

SEQ ID NO: 32516 - DNA, 203 bp, Homo sapiens; identical to SEQ ID NO: 13402
  source 1..203: mol_type = other DNA

SEQ ID NO: 32517 - DNA, 203 bp, Homo sapiens; identical to SEQ ID NO: 13403
  source 1..203: mol_type = other DNA

SEQ ID NO: 32518 - DNA, 203 bp, Homo sapiens; identical to SEQ ID NO: 13404
  source 1..203: mol_type = other DNA

SEQ ID NO: 32519 - DNA, 203 bp, Homo sapiens; identical to SEQ ID NO: 13415
  source 1..203: mol_type = other DNA

SEQ ID NO: 32520 - DNA, 203 bp, Homo sapiens; identical to SEQ ID NO: 13420
  source 1..203: mol_type = other DNA

SEQ ID NO: 32521 - DNA, 203 bp, Homo sapiens; identical to SEQ ID NO: 13422
  source 1..203: mol_type = other DNA

SEQ ID NO: 32522 - DNA, 203 bp, Homo sapiens; identical to SEQ ID NO: 13429
  source 1..203: mol_type = other DNA

SEQ ID NO: 32523 - DNA, 203 bp, Homo sapiens; identical to SEQ ID NO: 13430
  source 1..203: mol_type = other DNA

SEQ ID NO: 32524 - DNA, 203 bp, Homo sapiens; identical to SEQ ID NO: 13434
  source 1..203: mol_type = other DNA

SEQ ID NO: 32525 - DNA, 203 bp, Homo sapiens; identical to SEQ ID NO: 13435
  source 1..203: mol_type = other DNA

SEQ ID NO: 32526 - DNA, 203 bp, Homo sapiens; identical to SEQ ID NO: 13450
  source 1..203: mol_type = other DNA

SEQ ID NO: 32527 - DNA, 203 bp, Homo sapiens; identical to SEQ ID NO: 13463
  source 1..203: mol_type = other DNA

SEQ ID NO: 32528 - DNA, 203 bp, Homo sapiens; identical to SEQ ID NO: 13464
  source 1..203: mol_type = other DNA

SEQ ID NO: 32529 - DNA, 203 bp, Homo sapiens; identical to SEQ ID NO: 13465
  source 1..203: mol_type = other DNA

SEQ ID NO: 32530 - DNA, 203 bp, Homo sapiens; identical to SEQ ID NO: 13470
  source 1..203: mol_type = other DNA

SEQ ID NO: 32531 - DNA, 203 bp, Homo sapiens; identical to SEQ ID NO: 13472
  source 1..203: mol_type = other DNA

SEQ ID NO: 32532 - DNA, 203 bp, Homo sapiens; identical to SEQ ID NO: 13473
  source 1..203: mol_type = other DNA

SEQ ID NO: 32533 - DNA, 203 bp, Homo sapiens; identical to SEQ ID NO: 13482
  source 1..203: mol_type = other DNA

SEQ ID NO: 32534 - DNA, 203 bp, Homo sapiens; identical to SEQ ID NO: 13483
  source 1..203: mol_type = other DNA

SEQ ID NO: 32535 - DNA, 203 bp, Homo sapiens; identical to SEQ ID NO: 13484
  source 1..203: mol_type = other DNA

SEQ ID NO: 32536 - DNA, 203 bp, Homo sapiens; identical to SEQ ID NO: 13485
  source 1..203: mol_type = other DNA

SEQ ID NO: 32537 - DNA, 203 bp, Homo sapiens; identical to SEQ ID NO: 13486
  source 1..203: mol_type = other DNA

SEQ ID NO: 32538 - DNA, 203 bp, Homo sapiens; identical to SEQ ID NO: 13487
  source 1..203: mol_type = other DNA

SEQ ID NO: 32539 - DNA, 203 bp, Homo sapiens; identical to SEQ ID NO: 13488
  source 1..203: mol_type = other DNA

SEQ ID NO: 32540 - DNA, 203 bp, Homo sapiens; identical to SEQ ID NO: 13490
  source 1..203: mol_type = other DNA

SEQ ID NO: 32541 - DNA, 203 bp, Homo sapiens; identical to SEQ ID NO: 13491
  source 1..203: mol_type = other DNA

SEQ ID NO: 32542 - DNA, 203 bp, Homo sapiens; identical to SEQ ID NO: 13494
  source 1..203: mol_type = other DNA

SEQ ID NO: 32543 - DNA, 203 bp, Homo sapiens; identical to SEQ ID NO: 13496
  source 1..203: mol_type = other DNA

SEQ ID NO: 32544 - DNA, 203 bp, Homo sapiens; identical to SEQ ID NO: 13507
  source 1..203: mol_type = other DNA

SEQ ID NO: 32545 - DNA, 203 bp, Homo sapiens; identical to SEQ ID NO: 13508
  source 1..203: mol_type = other DNA

SEQ ID NO: 32546 - DNA, 203 bp, Homo sapiens; identical to SEQ ID NO: 13519
  source 1..203: mol_type = other DNA

SEQ ID NO: 32547 - DNA, 203 bp, Homo sapiens; identical to SEQ ID NO: 13520
  source 1..203: mol_type = other DNA

SEQ ID NO: 32548 - DNA, 203 bp, Homo sapiens; identical to SEQ ID NO: 13521
  source 1..203: mol_type = other DNA

SEQ ID NO: 32549 - DNA, 203 bp, Homo sapiens; identical to SEQ ID NO: 13531
  source 1..203: mol_type = other DNA

SEQ ID NO: 32550 - DNA, 203 bp, Homo sapiens; identical to SEQ ID NO: 13532
  source 1..203: mol_type = other DNA

SEQ ID NO: 32551 - DNA, 203 bp, Homo sapiens; identical to SEQ ID NO: 13533
  source 1..203: mol_type = other DNA

SEQ ID NO: 32552 - DNA, 203 bp, Homo sapiens; identical to SEQ ID NO: 13548
  source 1..203: mol_type = other DNA

SEQ ID NO: 32553 - DNA, 203 bp, Homo sapiens; identical to SEQ ID NO: 13583
  source 1..203: mol_type = other DNA

SEQ ID NO: 32554 - DNA, 203 bp, Homo sapiens; identical to SEQ ID NO: 13600
  source 1..203: mol_type = other DNA

SEQ ID NO: 32555 - DNA, 203 bp, Homo sapiens; identical to SEQ ID NO: 13622
  source 1..203: mol_type = other DNA

SEQ ID NO: 32556 - DNA, 203 bp, Homo sapiens; identical to SEQ ID NO: 13624
  source 1..203: mol_type = other DNA

SEQ ID NO: 32557 - DNA, 203 bp, Homo sapiens; identical to SEQ ID NO: 13626
  source 1..203: mol_type = other DNA

SEQ ID NO: 32558 - DNA, 203 bp, Homo sapiens; identical to SEQ ID NO: 13627
  source 1..203: mol_type = other DNA

SEQ ID NO: 32559 - DNA, 203 bp, Homo sapiens; identical to SEQ ID NO: 13628
  source 1..203: mol_type = other DNA

SEQ ID NO: 32560 - DNA, 203 bp, Homo sapiens; identical to SEQ ID NO: 13630
  source 1..203: mol_type = other DNA

SEQ ID NO: 32561 - DNA, 203 bp, Homo sapiens; identical to SEQ ID NO: 13631
  source 1..203: mol_type = other DNA

SEQ ID NO: 32562 - DNA, 203 bp, Homo sapiens; identical to SEQ ID NO: 13649
  source 1..203: mol_type = other DNA

SEQ ID NO: 32563 - DNA, 203 bp, Homo sapiens; identical to SEQ ID NO: 13653
  source 1..203: mol_type = other DNA

SEQ ID NO: 32564 - DNA, 203 bp, Homo sapiens; identical to SEQ ID NO: 13654
  source 1..203: mol_type = other DNA

SEQ ID NO: 32565 - DNA, 203 bp, Homo sapiens; identical to SEQ ID NO: 13668
  source 1..203: mol_type = other DNA

SEQ ID NO: 32566 - DNA, 203 bp, Homo sapiens; identical to SEQ ID NO: 13672
  source 1..203: mol_type = other DNA

SEQ ID NO: 32567 - DNA, 203 bp, Homo sapiens; identical to SEQ ID NO: 13673
  source 1..203: mol_type = other DNA

SEQ ID NO: 32568 - DNA, 203 bp, Homo sapiens; identical to SEQ ID NO: 13674
  source 1..203: mol_type = other DNA

SEQ ID NO: 32569 - DNA, 203 bp, Homo sapiens; identical to SEQ ID NO: 13677
  source 1..203: mol_type = other DNA

SEQ ID NO: 32570 - DNA, 203 bp, Homo sapiens; identical to SEQ ID NO: 13678
  source 1..203: mol_type = other DNA

SEQ ID NO: 32571 - DNA, 203 bp, Homo sapiens; identical to SEQ ID NO: 13679
  source 1..203: mol_type = other DNA

SEQ ID NO: 32572 - DNA, 203 bp, Homo sapiens; identical to SEQ ID NO: 13686
  source 1..203: mol_type = other DNA

SEQ ID NO: 32573 - DNA, 203 bp, Homo sapiens; identical to SEQ ID NO: 13687
  source 1..203: mol_type = other DNA

SEQ ID NO: 32574 - DNA, 203 bp, Homo sapiens; identical to SEQ ID NO: 13689
  source 1..203: mol_type = other DNA

SEQ ID NO: 32575 - DNA, 203 bp, Homo sapiens; identical to SEQ ID NO: 13690
  source 1..203: mol_type = other DNA

SEQ ID NO: 32576 - DNA, 203 bp, Homo sapiens; identical to SEQ ID NO: 13692
  source 1..203: mol_type = other DNA

SEQ ID NO: 32577 - DNA, 203 bp, Homo sapiens; identical to SEQ ID NO: 13700
  source 1..203: mol_type = other DNA

SEQ ID NO: 32578 - DNA, 203 bp, Homo sapiens; identical to SEQ ID NO: 13706
  source 1..203: mol_type = other DNA

SEQ ID NO: 32579 - DNA, 203 bp, Homo sapiens; identical to SEQ ID NO: 13709
  source 1..203: mol_type = other DNA

SEQ ID NO: 32580 - DNA, 203 bp, Homo sapiens; identical to SEQ ID NO: 13715
  source 1..203: mol_type = other DNA

SEQ ID NO: 32581 - DNA, 203 bp, Homo sapiens; identical to SEQ ID NO: 13716
  source 1..203: mol_type = other DNA

SEQ ID NO: 32582 - DNA, 203 bp, Homo sapiens; identical to SEQ ID NO: 13717
  source 1..203: mol_type = other DNA

SEQ ID NO: 32583 - DNA, 203 bp, Homo sapiens; identical to SEQ ID NO: 13718
  source 1..203: mol_type = other DNA

SEQ ID NO: 32584 - DNA, 203 bp, Homo sapiens; identical to SEQ ID NO: 13719
  source 1..203: mol_type = other DNA

SEQ ID NO: 32585 - DNA, 203 bp, Homo sapiens; identical to SEQ ID NO: 13720
  source 1..203: mol_type = other DNA

SEQ ID NO: 32586 - DNA, 203 bp, Homo sapiens; identical to SEQ ID NO: 13721
  source 1..203: mol_type = other DNA

SEQ ID NO: 32587 - DNA, 203 bp, Homo sapiens; identical to SEQ ID NO: 13722
  source 1..203: mol_type = other DNA

SEQ ID NO: 32588 - DNA, 203 bp, Homo sapiens; identical to SEQ ID NO: 13723
  source 1..203: mol_type = other DNA

SEQ ID NO: 32589 - DNA, 203 bp, Homo sapiens; identical to SEQ ID NO: 13724
  source 1..203: mol_type = other DNA

SEQ ID NO: 32590 - DNA, 203 bp, Homo sapiens; identical to SEQ ID NO: 13753
  source 1..203: mol_type = other DNA

SEQ ID NO: 32591 - DNA, 203 bp, Homo sapiens; identical to SEQ ID NO: 13754
  source 1..203: mol_type = other DNA

SEQ ID NO: 32592 - DNA, 203 bp, Homo sapiens; identical to SEQ ID NO: 13756
  source 1..203: mol_type = other DNA

SEQ ID NO: 32593 - DNA, 203 bp, Homo sapiens; identical to SEQ ID NO: 13758
  source 1..203: mol_type = other DNA

SEQ ID NO: 32594 - DNA, 203 bp, Homo sapiens; identical to SEQ ID NO: 13759
  source 1..203: mol_type = other DNA

SEQ ID NO: 32595 - DNA, 203 bp, Homo sapiens; identical to SEQ ID NO: 13760
  source 1..203: mol_type = other DNA

SEQ ID NO: 32596 - DNA, 203 bp, Homo sapiens; identical to SEQ ID NO: 13761
  source 1..203: mol_type = other DNA

SEQ ID NO: 32597 - DNA, 203 bp, Homo sapiens; identical to SEQ ID NO: 13762
  source 1..203: mol_type = other DNA

SEQ ID NO: 32598 - DNA, 203 bp, Homo sapiens; identical to SEQ ID NO: 13763
  source 1..203: mol_type = other DNA

SEQ ID NO: 32599 - DNA, 203 bp, Homo sapiens; identical to SEQ ID NO: 13764
  source 1..203: mol_type = other DNA

SEQ ID NO: 32600 - DNA, 203 bp, Homo sapiens; identical to SEQ ID NO: 13780
  source 1..203: mol_type = other DNA

SEQ ID NO: 32601 - DNA, 203 bp, Homo sapiens; identical to SEQ ID NO: 13781
  source 1..203: mol_type = other DNA

SEQ ID NO: 32602 - DNA, 203 bp, Homo sapiens; identical to SEQ ID NO: 13790
  source 1..203: mol_type = other DNA

SEQ ID NO: 32603 - DNA, 203 bp, Homo sapiens; identical to SEQ ID NO: 13792
  source 1..203: mol_type = other DNA

SEQ ID NO: 32604 - DNA, 203 bp, Homo sapiens; identical to SEQ ID NO: 13793
  source 1..203: mol_type = other DNA

SEQ ID NO: 32605 - DNA, 203 bp, Homo sapiens; identical to SEQ ID NO: 13794
  source 1..203: mol_type = other DNA

SEQ ID NO: 32606 - DNA, 203 bp, Homo sapiens; identical to SEQ ID NO: 13795
  source 1..203: mol_type = other DNA

SEQ ID NO: 32607 - DNA, 203 bp, Homo sapiens; identical to SEQ ID NO: 13798
  source 1..203: mol_type = other DNA

SEQ ID NO: 32608 - DNA, 203 bp, Homo sapiens; identical to SEQ ID NO: 13799
  source 1..203: mol_type = other DNA

SEQ ID NO: 32609 - DNA, 203 bp, Homo sapiens; identical to SEQ ID NO: 13800
  source 1..203: mol_type = other DNA

SEQ ID NO: 32610 - DNA, 203 bp, Homo sapiens; identical to SEQ ID NO: 13810
  source 1..203: mol_type = other DNA

SEQ ID NO: 32611 - DNA, 203 bp, Homo sapiens; identical to SEQ ID NO: 13811
  source 1..203: mol_type = other DNA

SEQ ID NO: 32612 - DNA, 203 bp, Homo sapiens; identical to SEQ ID NO: 13813
  source 1..203: mol_type = other DNA

SEQ ID NO: 32613 - DNA, 203 bp, Homo sapiens; identical to SEQ ID NO: 13814
  source 1..203: mol_type = other DNA

SEQ ID NO: 32614 - DNA, 203 bp, Homo sapiens; identical to SEQ ID NO: 13815
  source 1..203: mol_type = other DNA

SEQ ID NO: 32615 - DNA, 203 bp, Homo sapiens; identical to SEQ ID NO: 13816
  source 1..203: mol_type = other DNA

SEQ ID NO: 32616 - DNA, 203 bp, Homo sapiens; identical to SEQ ID NO: 13819
  source 1..203: mol_type = other DNA

SEQ ID NO: 32617 - DNA, 203 bp, Homo sapiens; identical to SEQ ID NO: 13823
  source 1..203: mol_type = other DNA

SEQ ID NO: 32618 - DNA, 203 bp, Homo sapiens; identical to SEQ ID NO: 13824
  source 1..203: mol_type = other DNA

SEQ ID NO: 32619 - DNA, 203 bp, Homo sapiens; identical to SEQ ID NO: 13827
  source 1..203: mol_type = other DNA

SEQ ID NO: 32620 - DNA, 203 bp, Homo sapiens; identical to SEQ ID NO: 13828
  source 1..203: mol_type = other DNA

SEQ ID NO: 32621 - DNA, 203 bp, Homo sapiens; identical to SEQ ID NO: 13829
  source 1..203: mol_type = other DNA

SEQ ID NO: 32622 - DNA, 203 bp, Homo sapiens; identical to SEQ ID NO: 13830
  source 1..203: mol_type = other DNA

SEQ ID NO: 32623 - DNA, 203 bp, Homo sapiens; identical to SEQ ID NO: 13831
  source 1..203: mol_type = other DNA

SEQ ID NO: 32624 - DNA, 203 bp, Homo sapiens; identical to SEQ ID NO: 13832
  source 1..203: mol_type = other DNA

SEQ ID NO: 32625 - DNA, 203 bp, Homo sapiens; identical to SEQ ID NO: 13833
  source 1..203: mol_type = other DNA

SEQ ID NO: 32626 - DNA, 203 bp, Homo sapiens; identical to SEQ ID NO: 13834
  source 1..203: mol_type = other DNA

SEQ ID NO: 32627 - DNA, 203 bp, Homo sapiens; identical to SEQ ID NO: 13836
  source 1..203: mol_type = other DNA

SEQ ID NO: 32628 - DNA, 203 bp, Homo sapiens; identical to SEQ ID NO: 13837
  source 1..203: mol_type = other DNA

SEQ ID NO: 32629 - DNA, 203 bp, Homo sapiens; identical to SEQ ID NO: 13841
  source 1..203: mol_type = other DNA

SEQ ID NO: 32630 - DNA, 203 bp, Homo sapiens; identical to SEQ ID NO: 13843
  source 1..203: mol_type = other DNA

SEQ ID NO: 32631 - DNA, 203 bp, Homo sapiens; identical to SEQ ID NO: 13844
  source 1..203: mol_type = other DNA

SEQ ID NO: 32632 - DNA, 203 bp, Homo sapiens; identical to SEQ ID NO: 13861
  source 1..203: mol_type = other DNA

SEQ ID NO: 32633 - DNA, 203 bp, Homo sapiens; identical to SEQ ID NO: 13865
  source 1..203: mol_type = other DNA

SEQ ID NO: 32634 - DNA, 203 bp, Homo sapiens; identical to SEQ ID NO: 13868
  source 1..203: mol_type = other DNA

SEQ ID NO: 32635 - DNA, 203 bp, Homo sapiens; identical to SEQ ID NO: 13871
  source 1..203: mol_type = other DNA

SEQ ID NO: 32636 - DNA, 203 bp, Homo sapiens; identical to SEQ ID NO: 13872
  source 1..203: mol_type = other DNA

SEQ ID NO: 32637 - DNA, 203 bp, Homo sapiens; identical to SEQ ID NO: 13879
  source 1..203: mol_type = other DNA

SEQ ID NO: 32638 - DNA, 203 bp, Homo sapiens; identical to SEQ ID NO: 13882
  source 1..203: mol_type = other DNA

SEQ ID NO: 32639 - DNA, 203 bp, Homo sapiens; identical to SEQ ID NO: 13920
  source 1..203: mol_type = other DNA

SEQ ID NO: 32640 - DNA, 203 bp, Homo sapiens; identical to SEQ ID NO: 13922
  source 1..203: mol_type = other DNA

SEQ ID NO: 32641 - DNA, 203 bp, Homo sapiens; identical to SEQ ID NO: 13929
  source 1..203: mol_type = other DNA

SEQ ID NO: 32642 - DNA, 203 bp, Homo sapiens; identical to SEQ ID NO: 13945
  source 1..203: mol_type = other DNA

SEQ ID NO: 32643 - DNA, 203 bp, Homo sapiens; identical to SEQ ID NO: 13954
  source 1..203: mol_type = other DNA

SEQ ID NO: 32644 - DNA, 203 bp, Homo sapiens; identical to SEQ ID NO: 13963
  source 1..203: mol_type = other DNA

SEQ ID NO: 32645 - DNA, 203 bp, Homo sapiens; identical to SEQ ID NO: 13964
  source 1..203: mol_type = other DNA

SEQ ID NO: 32646 - DNA, 203 bp, Homo sapiens; identical to SEQ ID NO: 13965
  source 1..203: mol_type = other DNA

SEQ ID NO: 32647 - DNA, 203 bp, Homo sapiens; identical to SEQ ID NO: 13994
  source 1..203: mol_type = other DNA

SEQ ID NO: 32648 - DNA, 203 bp, Homo sapiens; identical to SEQ ID NO: 14004
  source 1..203: mol_type = other DNA

SEQ ID NO: 32649 - DNA, 203 bp, Homo sapiens; identical to SEQ ID NO: 14026
  source 1..203: mol_type = other DNA

SEQ ID NO: 32650 - DNA, 203 bp, Homo sapiens; identical to SEQ ID NO: 14027
  source 1..203: mol_type = other DNA

SEQ ID NO: 32651 - DNA, 203 bp, Homo sapiens; identical to SEQ ID NO: 14029
  source 1..203: mol_type = other DNA

SEQ ID NO: 32652 - DNA, 203 bp, Homo sapiens; identical to SEQ ID NO: 14032
  source 1..203: mol_type = other DNA

SEQ ID NO: 32653 - DNA, 203 bp, Homo sapiens; identical to SEQ ID NO: 14033
  source 1..203: mol_type = other DNA

SEQ ID NO: 32654 - DNA, 203 bp, Homo sapiens; identical to SEQ ID NO: 14034
  source 1..203: mol_type = other DNA

SEQ ID NO: 32655 - DNA, 203 bp, Homo sapiens; identical to SEQ ID NO: 14036
  source 1..203: mol_type = other DNA

SEQ ID NO: 32656 - DNA, 203 bp, Homo sapiens; identical to SEQ ID NO: 14037
  source 1..203: mol_type = other DNA

SEQ ID NO: 32657 - DNA, 203 bp, Homo sapiens; identical to SEQ ID NO: 14038
  source 1..203: mol_type = other DNA

SEQ ID NO: 32658 - DNA, 203 bp, Homo sapiens; identical to SEQ ID NO: 14039
  source 1..203: mol_type = other DNA

SEQ ID NO: 32659 - DNA, 203 bp, Homo sapiens; identical to SEQ ID NO: 14042
  source 1..203: mol_type = other DNA

SEQ ID NO: 32660 - DNA, 203 bp, Homo sapiens; identical to SEQ ID NO: 14043
  source 1..203: mol_type = other DNA

SEQ ID NO: 32661 - DNA, 203 bp, Homo sapiens; identical to SEQ ID NO: 14055
  source 1..203: mol_type = other DNA

SEQ ID NO: 32662 - DNA, 203 bp, Homo sapiens; identical to SEQ ID NO: 14058
  source 1..203: mol_type = other DNA

SEQ ID NO: 32663 - DNA, 203 bp, Homo sapiens; identical to SEQ ID NO: 14059
  source 1..203: mol_type = other DNA

SEQ ID NO: 32664 - DNA, 203 bp, Homo sapiens; identical to SEQ ID NO: 14061
  source 1..203: mol_type = other DNA

SEQ ID NO: 32665 - DNA, 203 bp, Homo sapiens; identical to SEQ ID NO: 14063
  source 1..203: mol_type = other DNA

SEQ ID NO: 32666 - DNA, 203 bp, Homo sapiens; identical to SEQ ID NO: 14085
  source 1..203: mol_type = other DNA

SEQ ID NO: 32667 - DNA, 203 bp, Homo sapiens; identical to SEQ ID NO: 14086
  source 1..203: mol_type = other DNA

SEQ ID NO: 32668 - DNA, 203 bp, Homo sapiens; identical to SEQ ID NO: 14087
  source 1..203: mol_type = other DNA

SEQ ID NO: 32669 - DNA, 203 bp, Homo sapiens; identical to SEQ ID NO: 14088
  source 1..203: mol_type = other DNA

SEQ ID NO: 32670 - DNA, 203 bp, Homo sapiens; identical to SEQ ID NO: 14100
  source 1..203: mol_type = other DNA

SEQ ID NO: 32671 - DNA, 203 bp, Homo sapiens; identical to SEQ ID NO: 14111
  source 1..203: mol_type = other DNA

SEQ ID NO: 32672 - DNA, 203 bp, Homo sapiens; identical to SEQ ID NO: 14112
  source 1..203: mol_type = other DNA

SEQ ID NO: 32673 - DNA, 203 bp, Homo sapiens; identical to SEQ ID NO: 14113
  source 1..203: mol_type = other DNA

SEQ ID NO: 32674 - DNA, 203 bp, Homo sapiens; identical to SEQ ID NO: 14118
  source 1..203: mol_type = other DNA

SEQ ID NO: 32675 - DNA, 203 bp, Homo sapiens; identical to SEQ ID NO: 14119
  source 1..203: mol_type = other DNA

SEQ ID NO: 32676 - DNA, 203 bp, Homo sapiens; identical to SEQ ID NO: 14120
  source 1..203: mol_type = other DNA

SEQ ID NO: 32677 - DNA, 203 bp, Homo sapiens; identical to SEQ ID NO: 14121
  source 1..203: mol_type = other DNA

SEQ ID NO: 32678 - DNA, 203 bp, Homo sapiens; identical to SEQ ID NO: 14125
  source 1..203: mol_type = other DNA

SEQ ID NO: 32679 - DNA, 203 bp, Homo sapiens; identical to SEQ ID NO: 14126
  source 1..203: mol_type = other DNA

SEQ ID NO: 32680 - DNA, 203 bp, Homo sapiens; identical to SEQ ID NO: 14127
  source 1..203: mol_type = other DNA

SEQ ID NO: 32681 - DNA, 203 bp, Homo sapiens; identical to SEQ ID NO: 14130
  source 1..203: mol_type = other DNA

SEQ ID NO: 32682 - DNA, 203 bp, Homo sapiens; identical to SEQ ID NO: 14135
  source 1..203: mol_type = other DNA

SEQ ID NO: 32683 - DNA, 203 bp, Homo sapiens; identical to SEQ ID NO: 14136
  source 1..203: mol_type = other DNA

SEQ ID NO: 32684 - DNA, 203 bp, Homo sapiens; identical to SEQ ID NO: 14137
  source 1..203: mol_type = other DNA

SEQ ID NO: 32685 - DNA, 203 bp, Homo sapiens; identical to SEQ ID NO: 14144
  source 1..203: mol_type = other DNA

SEQ ID NO: 32686 - DNA, 203 bp, Homo sapiens; identical to SEQ ID NO: 14153
  source 1..203: mol_type = other DNA

SEQ ID NO: 32687 - DNA, 203 bp, Homo sapiens; identical to SEQ ID NO: 14154
  source 1..203: mol_type = other DNA

SEQ ID NO: 32688 - DNA, 203 bp, Homo sapiens; identical to SEQ ID NO: 14155
  source 1..203: mol_type = other DNA

SEQ ID NO: 32689 - DNA, 203 bp, Homo sapiens; identical to SEQ ID NO: 14156
  source 1..203: mol_type = other DNA

SEQ ID NO: 32690 - DNA, 203 bp, Homo sapiens; identical to SEQ ID NO: 14158
  source 1..203: mol_type = other DNA

SEQ ID NO: 32691 - DNA, 203 bp, Homo sapiens; identical to SEQ ID NO: 14159
  source 1..203: mol_type = other DNA

SEQ ID NO: 32692 - DNA, 203 bp, Homo sapiens; identical to SEQ ID NO: 14161
  source 1..203: mol_type = other DNA

SEQ ID NO: 32693 - DNA, 203 bp, Homo sapiens; identical to SEQ ID NO: 14162
  source 1..203: mol_type = other DNA

SEQ ID NO: 32694 - DNA, 203 bp, Homo sapiens; identical to SEQ ID NO: 14163
  source 1..203: mol_type = other DNA

SEQ ID NO: 32695 - DNA, 203 bp, Homo sapiens; identical to SEQ ID NO: 14165
  source 1..203: mol_type = other DNA

SEQ ID NO: 32696 - DNA, 203 bp, Homo sapiens; identical to SEQ ID NO: 14166
  source 1..203: mol_type = other DNA

SEQ ID NO: 32697 - DNA, 203 bp, Homo sapiens; identical to SEQ ID NO: 14167
  source 1..203: mol_type = other DNA

SEQ ID NO: 32698 - DNA, 203 bp, Homo sapiens; identical to SEQ ID NO: 14206
  source 1..203: mol_type = other DNA

SEQ ID NO: 32699 - DNA, 203 bp, Homo sapiens; identical to SEQ ID NO: 14208
  source 1..203: mol_type = other DNA

SEQ ID NO: 32700 - DNA, 203 bp, Homo sapiens; identical to SEQ ID NO: 14210
  source 1..203: mol_type = other DNA

SEQ ID NO: 32701 - DNA, 203 bp, Homo sapiens; identical to SEQ ID NO: 14218
  source 1..203: mol_type = other DNA

SEQ ID NO: 32702 - DNA, 203 bp, Homo sapiens; identical to SEQ ID NO: 14242
  source 1..203: mol_type = other DNA

SEQ ID NO: 32703 - DNA, 203 bp, Homo sapiens; identical to SEQ ID NO: 14244
  source 1..203: mol_type = other DNA

SEQ ID NO: 32704 - DNA, 203 bp, Homo sapiens; identical to SEQ ID NO: 14245
  source 1..203: mol_type = other DNA

SEQ ID NO: 32705 - DNA, 203 bp, Homo sapiens; identical to SEQ ID NO: 14275
  source 1..203: mol_type = other DNA

SEQ ID NO: 32706 - DNA, 203 bp, Homo sapiens; identical to SEQ ID NO: 14329
  source 1..203: mol_type = other DNA

SEQ ID NO: 32707 - DNA, 203 bp, Homo sapiens; identical to SEQ ID NO: 14330
  source 1..203: mol_type = other DNA

SEQ ID NO: 32708 - DNA, 203 bp, Homo sapiens; identical to SEQ ID NO: 14331
  source 1..203: mol_type = other DNA

SEQ ID NO: 32709 - DNA, 203 bp, Homo sapiens; identical to SEQ ID NO: 14332
  source 1..203: mol_type = other DNA

SEQ ID NO: 32710 - DNA, 203 bp, Homo sapiens; identical to SEQ ID NO: 14334
  source 1..203: mol_type = other DNA

SEQ ID NO: 32711 - DNA, 203 bp, Homo sapiens; identical to SEQ ID NO: 14339
  source 1..203: mol_type = other DNA

SEQ ID NO: 32712 - DNA, 203 bp, Homo sapiens; identical to SEQ ID NO: 14342
  source 1..203: mol_type = other DNA

SEQ ID NO: 32713 - DNA, 203 bp, Homo sapiens; identical to SEQ ID NO: 14343
  source 1..203: mol_type = other DNA

SEQ ID NO: 32714 - DNA, 203 bp, Homo sapiens; identical to SEQ ID NO: 14344
  source 1..203: mol_type = other DNA

SEQ ID NO: 32715 - DNA, 203 bp, Homo sapiens; identical to SEQ ID NO: 14346
  source 1..203: mol_type = other DNA

SEQ ID NO: 32716 - DNA, 203 bp, Homo sapiens; identical to SEQ ID NO: 14347
  source 1..203: mol_type = other DNA

SEQ ID NO: 32717 - DNA, 203 bp, Homo sapiens; identical to SEQ ID NO: 14349
  source 1..203: mol_type = other DNA

SEQ ID NO: 32718 - DNA, 203 bp, Homo sapiens; identical to SEQ ID NO: 14352
  source 1..203: mol_type = other DNA

SEQ ID NO: 32719 - DNA, 203 bp, Homo sapiens; identical to SEQ ID NO: 14376
  source 1..203: mol_type = other DNA

SEQ ID NO: 32720 - DNA, 203 bp, Homo sapiens; identical to SEQ ID NO: 14377
  source 1..203: mol_type = other DNA

SEQ ID NO: 32721 - DNA, 203 bp, Homo sapiens; identical to SEQ ID NO: 14379
  source 1..203: mol_type = other DNA

SEQ ID NO: 32722 - DNA, 203 bp, Homo sapiens; identical to SEQ ID NO: 14380
  source 1..203: mol_type = other DNA

SEQ ID NO: 32723 - DNA, 203 bp, Homo sapiens; identical to SEQ ID NO: 14382
  source 1..203: mol_type = other DNA

SEQ ID NO: 32724 - DNA, 203 bp, Homo sapiens; identical to SEQ ID NO: 14384
  source 1..203: mol_type = other DNA

SEQ ID NO: 32725 - DNA, 203 bp, Homo sapiens; identical to SEQ ID NO: 14387
  source 1..203: mol_type = other DNA

SEQ ID NO: 32726 - DNA, 203 bp, Homo sapiens; identical to SEQ ID NO: 14389
  source 1..203: mol_type = other DNA

SEQ ID NO: 32727 - DNA, 203 bp, Homo sapiens; identical to SEQ ID NO: 14390
  source 1..203: mol_type = other DNA

SEQ ID NO: 32728 - DNA, 203 bp, Homo sapiens; identical to SEQ ID NO: 14391
  source 1..203: mol_type = other DNA

SEQ ID NO: 32729 - DNA, 203 bp, Homo sapiens; identical to SEQ ID NO: 14395
  source 1..203: mol_type = other DNA

SEQ ID NO: 32730 - DNA, 203 bp, Homo sapiens; identical to SEQ ID NO: 14397
  source 1..203: mol_type = other DNA

SEQ ID NO: 32731 - DNA, 203 bp, Homo sapiens; identical to SEQ ID NO: 14398
  source 1..203: mol_type = other DNA

SEQ ID NO: 32732 - DNA, 203 bp, Homo sapiens; identical to SEQ ID NO: 14400
  source 1..203: mol_type = other DNA

SEQ ID NO: 32733 - DNA, 203 bp, Homo sapiens; identical to SEQ ID NO: 14402
  source 1..203: mol_type = other DNA

SEQ ID NO: 32734 - DNA, 203 bp, Homo sapiens; identical to SEQ ID NO: 14404
  source 1..203: mol_type = other DNA

SEQ ID NO: 32735 - DNA, 203 bp, Homo sapiens; identical to SEQ ID NO: 14405
  source 1..203: mol_type = other DNA

SEQ ID NO: 32736 - DNA, 203 bp, Homo sapiens; identical to SEQ ID NO: 14407
  source 1..203: mol_type = other DNA

SEQ ID NO: 32737 - DNA, 203 bp, Homo sapiens; identical to SEQ ID NO: 14408
  source 1..203: mol_type = other DNA

SEQ ID NO: 32738 - DNA, 203 bp, Homo sapiens; identical to SEQ ID NO: 14410
  source 1..203: mol_type = other DNA

SEQ ID NO: 32739 - DNA, 203 bp, Homo sapiens; identical to SEQ ID NO: 14412
  source 1..203: mol_type = other DNA

SEQ ID NO: 32740 - DNA, 203 bp, Homo sapiens; identical to SEQ ID NO: 14413
  source 1..203: mol_type = other DNA

SEQ ID NO: 32741 - DNA, 203 bp, Homo sapiens; identical to SEQ ID NO: 14423
  source 1..203: mol_type = other DNA

SEQ ID NO: 32742 - DNA, 203 bp, Homo sapiens; identical to SEQ ID NO: 14424
  source 1..203: mol_type = other DNA

SEQ ID NO: 32743 - DNA, 203 bp, Homo sapiens; identical to SEQ ID NO: 14425
  source 1..203: mol_type = other DNA

SEQ ID NO: 32744 - DNA, 203 bp, Homo sapiens; identical to SEQ ID NO: 14427
  source 1..203: mol_type = other DNA

SEQ ID NO: 32745 - DNA, 203 bp, Homo sapiens; identical to SEQ ID NO: 14428
  source 1..203: mol_type = other DNA

SEQ ID NO: 32746 - DNA, 203 bp, Homo sapiens; identical to SEQ ID NO: 14429
  source 1..203: mol_type = other DNA

SEQ ID NO: 32747 - DNA, 203 bp, Homo sapiens; identical to SEQ ID NO: 14430
  source 1..203: mol_type = other DNA

SEQ ID NO: 32748 - DNA, 203 bp, Homo sapiens; identical to SEQ ID NO: 14432
  source 1..203: mol_type = other DNA

SEQ ID NO: 32749 - DNA, 203 bp, Homo sapiens; identical to SEQ ID NO: 14434
  source 1..203: mol_type = other DNA

SEQ ID NO: 32750 - DNA, 203 bp, Homo sapiens; identical to SEQ ID NO: 14435
  source 1..203: mol_type = other DNA

SEQ ID NO: 32751 - DNA, 203 bp, Homo sapiens; identical to SEQ ID NO: 14436
  source 1..203: mol_type = other DNA

SEQ ID NO: 32752 - DNA, 203 bp, Homo sapiens; identical to SEQ ID NO: 14437
  source 1..203: mol_type = other DNA

SEQ ID NO: 32753 - DNA, 203 bp, Homo sapiens; identical to SEQ ID NO: 14438
  source 1..203: mol_type = other DNA

SEQ ID NO: 32754 - DNA, 203 bp, Homo sapiens; identical to SEQ ID NO: 14463
  source 1..203: mol_type = other DNA

SEQ ID NO: 32755 - DNA, 203 bp, Homo sapiens; identical to SEQ ID NO: 14540
  source 1..203: mol_type = other DNA

SEQ ID NO: 32756 - DNA, 203 bp, Homo sapiens; identical to SEQ ID NO: 14603
  source 1..203: mol_type = other DNA

SEQ ID NO: 32757 - DNA, 203 bp, Homo sapiens; identical to SEQ ID NO: 14605
  source 1..203: mol_type = other DNA

SEQ ID NO: 32758 - DNA, 203 bp, Homo sapiens; identical to SEQ ID NO: 14609
  source 1..203: mol_type = other DNA

SEQ ID NO: 32759 - DNA, 203 bp, Homo sapiens; identical to SEQ ID NO: 14613
  source 1..203: mol_type = other DNA

SEQ ID NO: 32760 - DNA, 203 bp, Homo sapiens; identical to SEQ ID NO: 14615
  source 1..203: mol_type = other DNA

SEQ ID NO: 32761 - DNA, 203 bp, Homo sapiens; identical to SEQ ID NO: 14700
  source 1..203: mol_type = other DNA

SEQ ID NO: 32762 - DNA, 203 bp, Homo sapiens; identical to SEQ ID NO: 14706
  source 1..203: mol_type = other DNA

SEQ ID NO: 32763 - DNA, 203 bp, Homo sapiens; identical to SEQ ID NO: 15251
  source 1..203: mol_type = other DNA

SEQ ID NO: 32764 - DNA, 203 bp, Homo sapiens; identical to SEQ ID NO: 15252
  source 1..203: mol_type = other DNA

SEQ ID NO: 32765 - DNA, 203 bp, Homo sapiens; identical to SEQ ID NO: 15265
  source 1..203: mol_type = other DNA

SEQ ID NO: 32766 - DNA, 203 bp, Homo sapiens; identical to SEQ ID NO: 15269
  source 1..203: mol_type = other DNA

SEQ ID NO: 32767 - DNA, 203 bp, Homo sapiens; identical to SEQ ID NO: 15275
  source 1..203: mol_type = other DNA

SEQ ID NO: 32768 - DNA, 203 bp, Homo sapiens; identical to SEQ ID NO: 15281
  source 1..203: mol_type = other DNA

SEQ ID NO: 32769 - DNA, 203 bp, Homo sapiens; identical to SEQ ID NO: 15287
  source 1..203: mol_type = other DNA

SEQ ID NO: 32770 - DNA, 203 bp, Homo sapiens; identical to SEQ ID NO: 15291
  source 1..203: mol_type = other DNA

SEQ ID NO: 32771 - DNA, 203 bp, Homo sapiens; identical to SEQ ID NO: 15292
  source 1..203: mol_type = other DNA

SEQ ID NO: 32772 - DNA, 203 bp, Homo sapiens; identical to SEQ ID NO: 15303
  source 1..203: mol_type = other DNA

SEQ ID NO: 32773 - DNA, 203 bp, Homo sapiens; identical to SEQ ID NO: 15307
  source 1..203: mol_type = other DNA

SEQ ID NO: 32774 - DNA, 203 bp, Homo sapiens; identical to SEQ ID NO: 15395
  source 1..203: mol_type = other DNA

SEQ ID NO: 32775 - DNA, 203 bp, Homo sapiens; identical to SEQ ID NO: 15398
  source 1..203: mol_type = other DNA

SEQ ID NO: 32776 - DNA, 203 bp, Homo sapiens; identical to SEQ ID NO: 15407
  source 1..203: mol_type = other DNA

SEQ ID NO: 32777 - DNA, 203 bp, Homo sapiens; identical to SEQ ID NO: 15572
  source 1..203: mol_type = other DNA

SEQ ID NO: 32778 - DNA, 203 bp, Homo sapiens; identical to SEQ ID NO: 15573
  source 1..203: mol_type = other DNA

SEQ ID NO: 32779 - DNA, 203 bp, Homo sapiens; identical to SEQ ID NO: 15575
  source 1..203: mol_type = other DNA

SEQ ID NO: 32780 - DNA, 203 bp, Homo sapiens; identical to SEQ ID NO: 15576
  source 1..203: mol_type = other DNA

SEQ ID NO: 32781 - DNA, 203 bp, Homo sapiens; identical to SEQ ID NO: 15578
  source 1..203: mol_type = other DNA

SEQ ID NO: 32782 - DNA, 203 bp, Homo sapiens; identical to SEQ ID NO: 15580
  source 1..203: mol_type = other DNA

SEQ ID NO: 32783 - DNA, 203 bp, Homo sapiens; identical to SEQ ID NO: 15581
  source 1..203: mol_type = other DNA

SEQ ID NO: 32784 - DNA, 203 bp, Homo sapiens; identical to SEQ ID NO: 15582
  source 1..203: mol_type = other DNA

SEQ ID NO: 32785 - DNA, 203 bp, Homo sapiens; identical to SEQ ID NO: 15584
  source 1..203: mol_type = other DNA

SEQ ID NO: 32786 - DNA, 203 bp, Homo sapiens; identical to SEQ ID NO: 15586
  source 1..203: mol_type = other DNA

SEQ ID NO: 32787 - DNA, 203 bp, Homo sapiens; identical to SEQ ID NO: 15587
  source 1..203: mol_type = other DNA

SEQ ID NO: 32788 - DNA, 203 bp, Homo sapiens; identical to SEQ ID NO: 15588
  source 1..203: mol_type = other DNA

SEQ ID NO: 32789 - DNA, 203 bp, Homo sapiens; identical to SEQ ID NO: 15589
  source 1..203: mol_type = other DNA

SEQ ID NO: 32790 - DNA, 203 bp, Homo sapiens; identical to SEQ ID NO: 15591
  source 1..203: mol_type = other DNA

SEQ ID NO: 32791 - DNA, 203 bp, Homo sapiens; identical to SEQ ID NO: 15592
  source 1..203: mol_type = other DNA

SEQ ID NO: 32792 - DNA, 203 bp, Homo sapiens; identical to SEQ ID NO: 15606
  source 1..203: mol_type = other DNA

SEQ ID NO: 32793 - DNA, 203 bp, Homo sapiens; identical to SEQ ID NO: 15617
  source 1..203: mol_type = other DNA

SEQ ID NO: 32794 - DNA, 203 bp, Homo sapiens; identical to SEQ ID NO: 15618
  source 1..203: mol_type = other DNA

SEQ ID NO: 32795 - DNA, 203 bp, Homo sapiens; identical to SEQ ID NO: 15620
  source 1..203: mol_type = other DNA

SEQ ID NO: 32796 - DNA, 203 bp, Homo sapiens; identical to SEQ ID NO: 15623
  source 1..203: mol_type = other DNA

SEQ ID NO: 32797 - DNA, 203 bp, Homo sapiens; identical to SEQ ID NO: 15629
  source 1..203: mol_type = other DNA

SEQ ID NO: 32798 - DNA, 203 bp, Homo sapiens; identical to SEQ ID NO: 15632
  source 1..203: mol_type = other DNA

SEQ ID NO: 32799 - DNA, 203 bp, Homo sapiens; identical to SEQ ID NO: 15636
  source 1..203: mol_type = other DNA

SEQ ID NO: 32800 - DNA, 203 bp, Homo sapiens; identical to SEQ ID NO: 15639
  source 1..203: mol_type = other DNA

SEQ ID NO: 32801 - DNA, 203 bp, Homo sapiens; identical to SEQ ID NO: 15640
  source 1..203: mol_type = other DNA

SEQ ID NO: 32802 - DNA, 203 bp, Homo sapiens; identical to SEQ ID NO: 15641
  source 1..203: mol_type = other DNA

SEQ ID NO: 32803 - DNA, 203 bp, Homo sapiens; identical to SEQ ID NO: 15643
  source 1..203: mol_type = other DNA

SEQ ID NO: 32804 - DNA, 203 bp, Homo sapiens; identical to SEQ ID NO: 15644
  source 1..203: mol_type = other DNA

SEQ ID NO: 32805 - DNA, 203 bp, Homo sapiens; identical to SEQ ID NO: 15645
  source 1..203: mol_type = other DNA

SEQ ID NO: 32806 - DNA, 203 bp, Homo sapiens; identical to SEQ ID NO: 15646
  source 1..203: mol_type = other DNA

SEQ ID NO: 32807 - DNA, 203 bp, Homo sapiens; identical to SEQ ID NO: 15647
  source 1..203: mol_type = other DNA

SEQ ID NO: 32808 - DNA, 203 bp, Homo sapiens; identical to SEQ ID NO: 15648
  source 1..203: mol_type = other DNA

SEQ ID NO: 32809 - DNA, 203 bp, Homo sapiens; identical to SEQ ID NO: 15650
  source 1..203: mol_type = other DNA

SEQ ID NO: 32810 - DNA, 203 bp, Homo sapiens; identical to SEQ ID NO: 15651
  source 1..203: mol_type = other DNA

SEQ ID NO: 32811 - DNA, 203 bp, Homo sapiens; identical to SEQ ID NO: 15652
  source 1..203: mol_type = other DNA

SEQ ID NO: 32812 - DNA, 203 bp, Homo sapiens; identical to SEQ ID NO: 15653
  source 1..203: mol_type = other DNA

SEQ ID NO: 32813 - DNA, 203 bp, Homo sapiens; identical to SEQ ID NO: 15655
  source 1..203: mol_type = other DNA

SEQ ID NO: 32814 - DNA, 203 bp, Homo sapiens; identical to SEQ ID NO: 15656
  source 1..203: mol_type = other DNA

SEQ ID NO: 32815 - DNA, 203 bp, Homo sapiens; identical to SEQ ID NO: 15657
  source 1..203: mol_type = other DNA

SEQ ID NO: 32816 - DNA, 203 bp, Homo sapiens; identical to SEQ ID NO: 15658
  source 1..203: mol_type = other DNA

SEQ ID NO: 32817 - DNA, 203 bp, Homo sapiens; identical to SEQ ID NO: 15659
  source 1..203: mol_type = other DNA

SEQ ID NO: 32818 - DNA, 203 bp, Homo sapiens; identical to SEQ ID NO: 15660
  source 1..203: mol_type = other DNA

SEQ ID NO: 32819 - DNA, 203 bp, Homo sapiens; identical to SEQ ID NO: 15661
  source 1..203: mol_type = other DNA

SEQ ID NO: 32820 - DNA, 203 bp, Homo sapiens; identical to SEQ ID NO: 15662
  source 1..203: mol_type = other DNA

SEQ ID NO: 32821 - DNA, 203 bp, Homo sapiens; identical to SEQ ID NO: 15683
  source 1..203: mol_type = other DNA

SEQ ID NO: 32822 - DNA, 203 bp, Homo sapiens; identical to SEQ ID NO: 15693
  source 1..203: mol_type = other DNA

SEQ ID NO: 32823 - DNA, 203 bp, Homo sapiens; identical to SEQ ID NO: 15694
  source 1..203: mol_type = other DNA

SEQ ID NO: 32824 - DNA, 203 bp, Homo sapiens; identical to SEQ ID NO: 15697
  source 1..203: mol_type = other DNA

SEQ ID NO: 32825 - DNA, 203 bp, Homo sapiens; identical to SEQ ID NO: 15698
  source 1..203: mol_type = other DNA

SEQ ID NO: 32826 - DNA, 203 bp, Homo sapiens; identical to SEQ ID NO: 15699
  source 1..203: mol_type = other DNA

SEQ ID NO: 32827 - DNA, 203 bp, Homo sapiens; identical to SEQ ID NO: 15723
  source 1..203: mol_type = other DNA

SEQ ID NO: 32828 - DNA, 203 bp, Homo sapiens; identical to SEQ ID NO: 15737
  source 1..203: mol_type = other DNA

SEQ ID NO: 32829 - DNA, 203 bp, Homo sapiens; identical to SEQ ID NO: 15743
  source 1..203: mol_type = other DNA

SEQ ID NO: 32830 - DNA, 203 bp, Homo sapiens; identical to SEQ ID NO: 15756
  source 1..203: mol_type = other DNA

SEQ ID NO: 32831 - DNA, 203 bp, Homo sapiens; identical to SEQ ID NO: 15760
  source 1..203: mol_type = other DNA

SEQ ID NO: 32832 - DNA, 203 bp, Homo sapiens; identical to SEQ ID NO: 15761
  source 1..203: mol_type = other DNA

SEQ ID NO: 32833 - DNA, 203 bp, Homo sapiens; identical to SEQ ID NO: 15762
  source 1..203: mol_type = other DNA

SEQ ID NO: 32834 - DNA, 203 bp, Homo sapiens; identical to SEQ ID NO: 15763
  source 1..203: mol_type = other DNA

SEQ ID NO: 32835 - DNA, 203 bp, Homo sapiens; identical to SEQ ID NO: 15809
  source 1..203: mol_type = other DNA

SEQ ID NO: 32836 - DNA, 203 bp, Homo sapiens; identical to SEQ ID NO: 15810
  source 1..203: mol_type = other DNA

SEQ ID NO: 32837 - DNA, 203 bp, Homo sapiens; identical to SEQ ID NO: 15817
  source 1..203: mol_type = other DNA

SEQ ID NO: 32838 - DNA, 203 bp, Homo sapiens; identical to SEQ ID NO: 15819
  source 1..203: mol_type = other DNA

SEQ ID NO: 32839 - DNA, 203 bp, Homo sapiens; identical to SEQ ID NO: 15823
  source 1..203: mol_type = other DNA

SEQ ID NO: 32840 - DNA, 203 bp, Homo sapiens; identical to SEQ ID NO: 15824
  source 1..203: mol_type = other DNA

SEQ ID NO: 32841 - DNA, 203 bp, Homo sapiens; identical to SEQ ID NO: 15826
  source 1..203: mol_type = other DNA

SEQ ID NO: 32842 - DNA, 203 bp, Homo sapiens; identical to SEQ ID NO: 15831
  source 1..203: mol_type = other DNA

SEQ ID NO: 32843 - DNA, 203 bp, Homo sapiens; identical to SEQ ID NO: 15832
  source 1..203: mol_type = other DNA

SEQ ID NO: 32844 - DNA, 203 bp, Homo sapiens; identical to SEQ ID NO: 15834
  source 1..203: mol_type = other DNA

SEQ ID NO: 32845 - DNA, 203 bp, Homo sapiens; identical to SEQ ID NO: 15836
  source 1..203: mol_type = other DNA

SEQ ID NO: 32846 - DNA, 203 bp, Homo sapiens; identical to SEQ ID NO: 15838
  source 1..203: mol_type = other DNA

SEQ ID NO: 32847 - DNA, 203 bp, Homo sapiens; identical to SEQ ID NO: 15839
  source 1..203: mol_type = other DNA

SEQ ID NO: 32848 - DNA, 203 bp, Homo sapiens; identical to SEQ ID NO: 15840
  source 1..203: mol_type = other DNA

SEQ ID NO: 32849 - DNA, 203 bp, Homo sapiens; identical to SEQ ID NO: 15843
  source 1..203: mol_type = other DNA

SEQ ID NO: 32850 - DNA, 203 bp, Homo sapiens; identical to SEQ ID NO: 15846
  source 1..203: mol_type = other DNA

SEQ ID NO: 32851 - DNA, 203 bp, Homo sapiens; identical to SEQ ID NO: 15847
  source 1..203: mol_type = other DNA

SEQ ID NO: 32852 - DNA, 203 bp, Homo sapiens; identical to SEQ ID NO: 15848
  source 1..203: mol_type = other DNA

SEQ ID NO: 32853 - DNA, 203 bp, Homo sapiens; identical to SEQ ID NO: 15849
  source 1..203: mol_type = other DNA

SEQ ID NO: 32854 - DNA, 203 bp, Homo sapiens; identical to SEQ ID NO: 15851
  source 1..203: mol_type = other DNA

SEQ ID NO: 32855 - DNA, 203 bp, Homo sapiens; identical to SEQ ID NO: 15855
  source 1..203: mol_type = other DNA

SEQ ID NO: 32856 - DNA, 203 bp, Homo sapiens; identical to SEQ ID NO: 15857
  source 1..203: mol_type = other DNA

SEQ ID NO: 32857 - DNA, 203 bp, Homo sapiens; identical to SEQ ID NO: 15862
  source 1..203: mol_type = other DNA

SEQ ID NO: 32858 - DNA, 203 bp, Homo sapiens; identical to SEQ ID NO: 15863
  source 1..203: mol_type = other DNA

SEQ ID NO: 32859 - DNA, 203 bp, Homo sapiens; identical to SEQ ID NO: 15865
  source 1..203: mol_type = other DNA

SEQ ID NO: 32860 - DNA, 203 bp, Homo sapiens; identical to SEQ ID NO: 15867
  source 1..203: mol_type = other DNA

SEQ ID NO: 32861 - DNA, 203 bp, Homo sapiens; identical to SEQ ID NO: 15870
  source 1..203: mol_type = other DNA

SEQ ID NO: 32862 - DNA, 203 bp, Homo sapiens; identical to SEQ ID NO: 15873
  source 1..203: mol_type = other DNA

SEQ ID NO: 32863 - DNA, 203 bp, Homo sapiens; identical to SEQ ID NO: 15875
  source 1..203: mol_type = other DNA

SEQ ID NO: 32864 - DNA, 203 bp, Homo sapiens; identical to SEQ ID NO: 15876
  source 1..203: mol_type = other DNA

SEQ ID NO: 32865 - DNA, 203 bp, Homo sapiens; identical to SEQ ID NO: 15880
  source 1..203: mol_type = other DNA

SEQ ID NO: 32866 - DNA, 203 bp, Homo sapiens; identical to SEQ ID NO: 15881
  source 1..203: mol_type = other DNA

SEQ ID NO: 32867 - DNA, 203 bp, Homo sapiens; identical to SEQ ID NO: 15882
  source 1..203: mol_type = other DNA

SEQ ID NO: 32868 - DNA, 203 bp, Homo sapiens; identical to SEQ ID NO: 15885
  source 1..203: mol_type = other DNA

SEQ ID NO: 32869 - DNA, 203 bp, Homo sapiens; identical to SEQ ID NO: 15886
  source 1..203: mol_type = other DNA

SEQ ID NO: 32870 - DNA, 203 bp, Homo sapiens; identical to SEQ ID NO: 15889
  source 1..203: mol_type = other DNA

SEQ ID NO: 32871 - DNA, 203 bp, Homo sapiens; identical to SEQ ID NO: 15890
  source 1..203: mol_type = other DNA

SEQ ID NO: 32872 - DNA, 203 bp, Homo sapiens; identical to SEQ ID NO: 15891
  source 1..203: mol_type = other DNA

SEQ ID NO: 32873 - DNA, 203 bp, Homo sapiens; identical to SEQ ID NO: 15893
  source 1..203: mol_type = other DNA

SEQ ID NO: 32874 - DNA, 203 bp, Homo sapiens; identical to SEQ ID NO: 15894
  source 1..203: mol_type = other DNA

SEQ ID NO: 32875 - DNA, 203 bp, Homo sapiens; identical to SEQ ID NO: 15898
  source 1..203: mol_type = other DNA

SEQ ID NO: 32876 - DNA, 203 bp, Homo sapiens; identical to SEQ ID NO: 15899
  source 1..203: mol_type = other DNA

SEQ ID NO: 32877 - DNA, 203 bp, Homo sapiens; identical to SEQ ID NO: 15902
  source 1..203: mol_type = other DNA

SEQ ID NO: 32878 - DNA, 203 bp, Homo sapiens; identical to SEQ ID NO: 15903
  source 1..203: mol_type = other DNA

SEQ ID NO: 32879 - DNA, 203 bp, Homo sapiens; identical to SEQ ID NO: 15904
  source 1..203: mol_type = other DNA

SEQ ID NO: 32880 - DNA, 203 bp, Homo sapiens; identical to SEQ ID NO: 15905
  source 1..203: mol_type = other DNA

SEQ ID NO: 32881 - DNA, 203 bp, Homo sapiens; identical to SEQ ID NO: 15907
  source 1..203: mol_type = other DNA

SEQ ID NO: 32882 - DNA, 203 bp, Homo sapiens; identical to SEQ ID NO: 15908
  source 1..203: mol_type = other DNA

SEQ ID NO: 32883 - DNA, 203 bp, Homo sapiens; identical to SEQ ID NO: 15909
  source 1..203: mol_type = other DNA

SEQ ID NO: 32884 - DNA, 203 bp, Homo sapiens; identical to SEQ ID NO: 15910
  source 1..203: mol_type = other DNA

SEQ ID NO: 32885 - DNA, 203 bp, Homo sapiens; identical to SEQ ID NO: 15911
  source 1..203: mol_type = other DNA

SEQ ID NO: 32886 - DNA, 203 bp, Homo sapiens; identical to SEQ ID NO: 15912
  source 1..203: mol_type = other DNA

SEQ ID NO: 32887 - DNA, 203 bp, Homo sapiens; identical to SEQ ID NO: 15913
  source 1..203: mol_type = other DNA

SEQ ID NO: 32888 - DNA, 203 bp, Homo sapiens; identical to SEQ ID NO: 15914
  source 1..203: mol_type = other DNA

SEQ ID NO: 32889 - DNA, 203 bp, Homo sapiens; identical to SEQ ID NO: 15915
  source 1..203: mol_type = other DNA

SEQ ID NO: 32890 - DNA, 203 bp, Homo sapiens; identical to SEQ ID NO: 15916
  source 1..203: mol_type = other DNA

SEQ ID NO: 32891 - DNA, 203 bp, Homo sapiens; identical to SEQ ID NO: 15917
  source 1..203: mol_type = other DNA

SEQ ID NO: 32892 - DNA, 203 bp, Homo sapiens; identical to SEQ ID NO: 15918
  source 1..203: mol_type = other DNA

SEQ ID NO: 32893 - DNA, 203 bp, Homo sapiens; identical to SEQ ID NO: 15919
  source 1..203: mol_type = other DNA

SEQ ID NO: 32894 - DNA, 203 bp, Homo sapiens; identical to SEQ ID NO: 15920
  source 1..203: mol_type = other DNA

SEQ ID NO: 32895 - DNA, 203 bp, Homo sapiens; identical to SEQ ID NO: 15921
  source 1..203: mol_type = other DNA

SEQ ID NO: 32896 - DNA, 203 bp, Homo sapiens; identical to SEQ ID NO: 15922
  source 1..203: mol_type = other DNA

SEQ ID NO: 32897 - DNA, 203 bp, Homo sapiens; identical to SEQ ID NO: 15923
  source 1..203: mol_type = other DNA

SEQ ID NO: 32898 - DNA, 203 bp, Homo sapiens; identical to SEQ ID NO: 15924
  source 1..203: mol_type = other DNA

SEQ ID NO: 32899 - DNA, 203 bp, Homo sapiens; identical to SEQ ID NO: 15925
  source 1..203: mol_type = other DNA

SEQ ID NO: 32900 - DNA, 203 bp, Homo sapiens; identical to SEQ ID NO: 15926
  source 1..203: mol_type = other DNA

SEQ ID NO: 32901 - DNA, 203 bp, Homo sapiens; identical to SEQ ID NO: 15927
  source 1..203: mol_type = other DNA

SEQ ID NO: 32902 - DNA, 203 bp, Homo sapiens; identical to SEQ ID NO: 15928
  source 1..203: mol_type = other DNA

SEQ ID NO: 32903 - DNA, 203 bp, Homo sapiens; identical to SEQ ID NO: 15929
  source 1..203: mol_type = other DNA

SEQ ID NO: 32904 - DNA, 203 bp, Homo sapiens; identical to SEQ ID NO: 15930
  source 1..203: mol_type = other DNA

SEQ ID NO: 32905 - DNA, 203 bp, Homo sapiens; identical to SEQ ID NO: 15932
  source 1..203: mol_type = other DNA

SEQ ID NO: 32906 - DNA, 203 bp, Homo sapiens; identical to SEQ ID NO: 15933
  source 1..203: mol_type = other DNA

SEQ ID NO: 32907 - DNA, 203 bp, Homo sapiens; identical to SEQ ID NO: 15934
  source 1..203: mol_type = other DNA

SEQ ID NO: 32908 - DNA, 203 bp, Homo sapiens; identical to SEQ ID NO: 15937
  source 1..203: mol_type = other DNA

SEQ ID NO: 32909 - DNA, 203 bp, Homo sapiens; identical to SEQ ID NO: 15938
  source 1..203: mol_type = other DNA

SEQ ID NO: 32910 - DNA, 203 bp, Homo sapiens; identical to SEQ ID NO: 15939
  source 1..203: mol_type = other DNA

SEQ ID NO: 32911 - DNA, 203 bp, Homo sapiens; identical to SEQ ID NO: 15941
  source 1..203: mol_type = other DNA

SEQ ID NO: 32912 - DNA, 203 bp, Homo sapiens; identical to SEQ ID NO: 15942
  source 1..203: mol_type = other DNA

SEQ ID NO: 32913 - DNA, 203 bp, Homo sapiens; identical to SEQ ID NO: 15943
  source 1..203: mol_type = other DNA

SEQ ID NO: 32914 - DNA, 203 bp, Homo sapiens; identical to SEQ ID NO: 15944
  source 1..203: mol_type = other DNA

SEQ ID NO: 32915 - DNA, 203 bp, Homo sapiens; identical to SEQ ID NO: 15946
  source 1..203: mol_type = other DNA

SEQ ID NO: 32916 - DNA, 203 bp, Homo sapiens; identical to SEQ ID NO: 15947
  source 1..203: mol_type = other DNA

SEQ ID NO: 32917 - DNA, 203 bp, Homo sapiens; identical to SEQ ID NO: 15948
  source 1..203: mol_type = other DNA

SEQ ID NO: 32918 - DNA, 203 bp, Homo sapiens; identical to SEQ ID NO: 15950
  source 1..203: mol_type = other DNA

SEQ ID NO: 32919 - DNA, 203 bp, Homo sapiens; identical to SEQ ID NO: 15954
  source 1..203: mol_type = other DNA

SEQ ID NO: 32920 - DNA, 203 bp, Homo sapiens; identical to SEQ ID NO: 15955
  source 1..203: mol_type = other DNA

SEQ ID NO: 32921 - DNA, 203 bp, Homo sapiens; identical to SEQ ID NO: 15958
  source 1..203: mol_type = other DNA

SEQ ID NO: 32922 - DNA, 203 bp, Homo sapiens; identical to SEQ ID NO: 15959
  source 1..203: mol_type = other DNA

SEQ ID NO: 32923 - DNA, 203 bp, Homo sapiens; identical to SEQ ID NO: 15960
  source 1..203: mol_type = other DNA

SEQ ID NO: 32924 - DNA, 203 bp, Homo sapiens; identical to SEQ ID NO: 15961
  source 1..203: mol_type = other DNA

SEQ ID NO: 32925 - DNA, 203 bp, Homo sapiens; identical to SEQ ID NO: 15962
  source 1..203: mol_type = other DNA

SEQ ID NO: 32926 - DNA, 203 bp, Homo sapiens; identical to SEQ ID NO: 15963
  source 1..203: mol_type = other DNA

SEQ ID NO: 32927 - DNA, 203 bp, Homo sapiens; identical to SEQ ID NO: 15967
  source 1..203: mol_type = other DNA

SEQ ID NO: 32928 - DNA, 203 bp, Homo sapiens; identical to SEQ ID NO: 15968
  source 1..203: mol_type = other DNA

SEQ ID NO: 32929 - DNA, 203 bp, Homo sapiens; identical to SEQ ID NO: 15973
  source 1..203: mol_type = other DNA

SEQ ID NO: 32930 - DNA, 203 bp, Homo sapiens; identical to SEQ ID NO: 15975
  source 1..203: mol_type = other DNA

SEQ ID NO: 32931 - DNA, 203 bp, Homo sapiens; identical to SEQ ID NO: 15976
  source 1..203: mol_type = other DNA

SEQ ID NO: 32932 - DNA, 203 bp, Homo sapiens; identical to SEQ ID NO: 15977
  source 1..203: mol_type = other DNA

SEQ ID NO: 32933 - DNA, 203 bp, Homo sapiens; identical to SEQ ID NO: 15979
  source 1..203: mol_type = other DNA

SEQ ID NO: 32934 - DNA, 203 bp, Homo sapiens; identical to SEQ ID NO: 15985
  source 1..203: mol_type = other DNA

SEQ ID NO: 32935 - DNA, 203 bp, Homo sapiens; identical to SEQ ID NO: 15994
  source 1..203: mol_type = other DNA

SEQ ID NO: 32936 - DNA, 203 bp, Homo sapiens; identical to SEQ ID NO: 15995
  source 1..203: mol_type = other DNA

SEQ ID NO: 32937 - DNA, 203 bp, Homo sapiens; identical to SEQ ID NO: 15998
  source 1..203: mol_type = other DNA

SEQ ID NO: 32938 - DNA, 203 bp, Homo sapiens; identical to SEQ ID NO: 15999
  source 1..203: mol_type = other DNA

SEQ ID NO: 32939 - DNA, 203 bp, Homo sapiens; identical to SEQ ID NO: 16000
  source 1..203: mol_type = other DNA

SEQ ID NO: 32940 - DNA, 203 bp, Homo sapiens; identical to SEQ ID NO: 16010
  source 1..203: mol_type = other DNA

SEQ ID NO: 32941 - DNA, 203 bp, Homo sapiens; identical to SEQ ID NO: 16012
  source 1..203: mol_type = other DNA

SEQ ID NO: 32942 - DNA, 203 bp, Homo sapiens; identical to SEQ ID NO: 16013
  source 1..203: mol_type = other DNA

SEQ ID NO: 32943 - DNA, 203 bp, Homo sapiens; identical to SEQ ID NO: 17158
  source 1..203: mol_type = other DNA

SEQ ID NO: 32944 - DNA, 203 bp, Homo sapiens; identical to SEQ ID NO: 17186
  source 1..203: mol_type = other DNA

SEQ ID NO: 32945 - DNA, 203 bp, Homo sapiens; identical to SEQ ID NO: 17189
  source 1..203: mol_type = other DNA

SEQ ID NO: 32946 - DNA, 203 bp, Homo sapiens; identical to SEQ ID NO: 17192
  source 1..203: mol_type = other DNA

SEQ ID NO: 32947 - DNA, 203 bp, Homo sapiens; identical to SEQ ID NO: 17193
  source 1..203: mol_type = other DNA

SEQ ID NO: 32948 - DNA, 203 bp, Homo sapiens; identical to SEQ ID NO: 17194
  source 1..203: mol_type = other DNA

SEQ ID NO: 32949 - DNA, 203 bp, Homo sapiens; identical to SEQ ID NO: 17195
  source 1..203: mol_type = other DNA

SEQ ID NO: 32950 - DNA, 203 bp, Homo sapiens; identical to SEQ ID NO: 17196
  source 1..203: mol_type = other DNA

SEQ ID NO: 32951 - DNA, 203 bp, Homo sapiens; identical to SEQ ID NO: 17197
  source 1..203: mol_type = other DNA

SEQ ID NO: 32952 - DNA, 203 bp, Homo sapiens; identical to SEQ ID NO: 17198
  source 1..203: mol_type = other DNA

SEQ ID NO: 32953 - DNA, 203 bp, Homo sapiens; identical to SEQ ID NO: 17200
  source 1..203: mol_type = other DNA

SEQ ID NO: 32954 - protein, 553 aa, Homo sapiens
MEPNSLRTKVPAFLSDLGKATLRGIRKCPRCGTYNGTRGLSCKNKTCGTIFRYGARKQPSVEAVKIITGSDLQVYSVRQRDRGPDYRCFVELGVSETTIQTVDGTIITQLSSGRCYVPSCLKAATQGVVENQCQHIKLAVNCQAEATPLTLKSSVLNAMQASPETKQTIWQLATEPTGPLVQRITKNILVVKCKASQKHSLGYLHTSFVQKVSGKSLPERRFFCSCQTLKSHKSNASKDETAQRCIHFFACICAFASDETLAQEFSDFLNFDSSGLKEIIVPQLGCHSESTVSACESTASKSKKRRKDEVSGAQMNSSLLPQDAVSSNLRKSGLKKPVVASSLKRQACGQLLDEAQVTLSFQDWLASVTERIHQTMHYQFDGKPEPLVFHIPQSFFDALQQRISIGSAKKRLPNSTTAFVRKDALPLGTFSKYTWHITNILQVKQILDTPEMPLEITRSFIQNRDGTYELFKCPKVEVESIAETYGRIEKQPVLRPLELKTFLKVDYQDLHLGKWESYLRNIGQKLCHWLVEKEEAECLHCYTIQLKLQKILG

SEQ ID NO: 32955 - protein, 15 aa, Homo sapiens
AVIISLQMIVFSPDH

SEQ ID NO: 32956 - protein, 24 aa, Homo sapiens
IQVTLFSRCLGSWYRASEKWNQIL

SEQ ID NO: 32957 - protein, 623 aa, Homo sapiens
MEDFEDDPRALGARGHRRSVSRGSYQLQAQMNRAVYEDRYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYEDRYNAYRTPTFPQFRTQYIRRRSQLLRENAKAGHPPALRRQYLRLRGQLLGQRYGPLSEPGSARAYSNSIVRSSRTTLDRMEDFEDDPRALGARGHRRSVSRGSYQLQAQMNRAVYED

SEQ ID NO: 32958 - protein, 20 aa, Homo sapiens
ASCCGRMPRLGTPQRCVGST

SEQ ID NO: 32959 - protein, 67 aa, Homo sapiens
GFGGSCWASATGPSPSQAVLVPIATASSAVAALLLTAWRTLRMILGPWGPVGTVVLSAEAPTSCRRR

SEQ ID NO: 32960 - protein, 29 aa, Homo sapiens
IPIAVITAITTATSIFLQIPPLLPRDFLL

SEQ ID NO: 32961 - protein, 440 aa, Homo sapiens
MGWLFLKVLLAGVSFSGFLYPLVDFCISGKTRGQKPNFVIILADDMGWGDLGANWAETKDTANLDKMASEGMRFVDFHAAASTCSPSRASLLTGRLGLRNGVTRNFAVTSVGGLPLNETTLAEVLQQAGYVTGIIGKWHLGHHGSYHPNFRGFDYYFGIPYSHDMGCTDTPGYNHPPCPACPQGDGPSRNLQRDCYTDVALPLYENLNIVEQPVNLSSLAQKYAEKATQFIQRASTSGRPFLLYVALAHMHVPLPVTQLPAAPRGRSLYGAGLWEMDSLVGQIKDKVDHTVKENTFLWFTGDNGPWAQKCELAGSVGPFTGFWQTRQGGSPAKQTTWEGGHRVPALAYWPGRVPVNVTSTALLSVLDIFPTVVALAQASLPQGRRFDGVDVSEVLFGRSQPGHRVLFHPNSGAAGEFGALQTVRLERYKAFYITGNLTET

SEQ ID NO: 32962 - protein, 466 aa, Homo sapiens
AERKLSEKSLVVAAVAPDNRNPAFTTMGWLFLKVLLAGVSFSGFLYPLVDFCISGKTRGQKPNFVIILADDMGWGDLGANWAETKDTANLDKMASEGMRFVDFHAAASTCSPSRASLLTGRLGLRNGVTRNFAVTSVGGLPLNETTLAEVLQQAGYVTGIIGKWHLGHHGSYHPNFRGFDYYFGIPYSHDMGCTDTPGYNHPPCPACPQGDGPSRNLQRDCYTDVALPLYENLNIVEQPVNLSSLAQKYAEKATQFIQRASTSGRPFLLYVALAHMHVPLPVTQLPAAPRGRSLYGAGLWEMDSLVGQIKDKVDHTVKENTFLWFTGDNGPWAQKCELAGSVGPFTGFWQTRQGGSPAKQTTWEGGHRVPALAYWPGRVPVNVTSTALLSVLDIFPTVVALAQASLPQGRRFDGVDVSEVLFGRSQPGHRVLFHPNSGAAGEFGALQTVRLERYKAFYITGNLTET

SEQ ID NO: 32963 - protein, 140 aa, Homo sapiens
MPLPEPSEQEGESVKASQEPSPKPGTEVIPAAPRKPRKFSKLVLLTASKDSTKVAGAKRKGVHCVMSLGVPGPATLAKALLQTHPEAQRAIEAAPQEPEQKRSRQDPGTDRTEDSGLAAGPPEAAGENFAPCSVAPGKSL

SEQ ID NO: 32964 - protein, 46 aa, Homo sapiens
TVGSTTSPHRCPHPARAAPALAQTQGRNRWTPGSLPGSRRNPPAGG

SEQ ID NO: 32965 - protein, 151 aa, Homo sapiens
VWPEGQALGPGMPLPEPSEQEGESVKASQEPSPKPGTEVIPAAPRKPRKFSKLVLLTASKDSTKVAGAKRKGVHCVMSLGVPGPATLAKALLQTHPEAQRAIEAAPQEPEQKRSRQDPGTDRTEDSGLAAGPPEAAGENFAPCSVAPGKSL

SEQ ID NO: 32966 - protein, 22 aa, Homo sapiens
VRIKSEENLHSTDSTDILECIQ

SEQ ID NO: 32967 - protein, 147 aa, Homo sapiens
MRGERRPLWEEESNAKGGVWKMKVPKDSTSTVWKELLLATIGEQFTDCAAADDEVIGVSVSVRDREDVVQVWNVNASLVGEATVLEKIYELLPHITFKAVFYKRAVGSPSLPLFCHPKSSVLRVMQWDSTLVRTSSYPRSSPASVIS

SEQ ID NO: 32968 - protein, 28 aa, Homo sapiens
MNSQPQTRSPVSKQKLEPNYILYLCLCV

SEQ ID NO: 32969 - protein, 9 aa, Homo sapiens
IHNLKPVLR

SEQ ID NO: 32970 - protein, 14 aa, Homo sapiens
IHNLKPVLRNPTEY

SEQ ID NO: 32971 - protein, 385 aa, Homo sapiens
MNSQPQTRSPVTQVARQPGTPTPSPYSAHEINKGHPNLAATPPGHASSPGLSQTPYPSGQNAGPTTLVYPQTPQTMNSQPQTRSPVTQVARQPGTPTPSPYSAHEINKGHPNLAATPPGHASSPGLSQTPYPSGQNAGPTTLVYPQTPQTMNSQPQTRSPVTQVARQPGTPTPSPYSAHEINKGHPNLAATPPGHASSPGLSQTPYPSGQNAGPTTLVYPQTPQTMNSQPQTRSPVTQVARQPGTPTPSPYSAHEINKGHPNLAATPPGHASSPGLSQTPYPSGQNAGPTTLVYPQTPQTMNSQPQTRSPVTQVARQPGTPTPSPYSAHEINKGHPNLAATPPGHASSPGLSQTPYPSGQNAGPTTLVYPQTPQTMNSQPQTRSP

SEQ ID NO: 32972 - protein, 133 aa, Homo sapiens
IHNLKPVLRLQRGLDLPIIRIPRGPVQQPLEDRIFTPAVSAVYSTVTQVARQPGTPTPSPYSAHEINKGHPNLAATPPGHASSPGLSQTPYPSGQNAGPTTLVYPQTPQTMNSQPQTRSPFAAGPRPPHHQNS

SEQ ID NO: 32973 - protein, 12 aa, Homo sapiens
IHNLKPVLRDTY

SEQ ID NO: 32974 - protein, 355 aa, Homo sapiens
MWTPELAILRGFPTEAERQQWKQEGVVGSESGSFLQLLLEGNYEAIFLNSMTQNIFNSTTTAEEKIDSYLEKQVVTFLDYSTDLDTTERQQLIFLLGVSSLQLFVQSNWTGPPVDLHPQDFLSSVLFQQFSEVKGLDAFVLSLLTLDGESIYSLTSKPILLLLARIILVNVRHKLTAIQSLPWWTLRCVNIHQHLLEERSPLLFTLAENCIDQVMKLQNLFVDDSGRYLAIQFHLECAYVFLYYYEYRKAKDQLDIAKDISQLQIDLTGALGKRTRFQENYVAQLILDVRREGDVLSNCEFTPAPTPQEHLTKNLELNDDTILNDIKLADCEQFQMPDLCAEEIAIILGIWLRCN

SEQ ID NO: 32975 - protein, 20 aa, Homo sapiens
GRLLEVVSAHGILGPQVYLR

SEQ ID NO: 32976 - protein, 392 aa, Homo sapiens
LSPLDFSAFGLSCFHFLLLTPVWPSWEPVLAAAVSGVMWTPELAILRGFPTEAERQQWKQEGVVGSESGSFLQLLLEGNYEAIFLNSMTQNIFNSTTTAEEKIDSYLEKQVVTFLDYSTDLDTTERQQLIFLLGVSSLQLFVQSNWTGPPVDLHPQDFLSSVLFQQFSEVKGLDAFVLSLLTLDGESIYSLTSKPILLLLARIILVNVRHKLTAIQSLPWWTLRCVNIHQHLLEERSPLLFTLAENCIDQVMKLQNLFVDDSGRYLAIQFHLECAYVFLYYYEYRKAKDQLDIAKDISQLQIDLTGALGKRTRFQENYVAQLILDVRREGDVLSNCEFTPAPTPQEHLTKNLELNDDTILNDIKLADCEQFQMPDLCAEEIAIILGIWLRCN

SEQ ID NO: 32977 - protein, 11 aa, Homo sapiens
GRRCIYGNCRH

SEQ ID NO: 32978 - protein, 14 aa, Homo sapiens
ISAPLDSPVFTFFC

SEQ ID NO: 32979 - protein, 58 aa, Homo sapiens
MTVVTMASARVQDLIGLICWQYTSEGREPKLNSKIRTTPKRETKPDQMQKYSVERKKF

SEQ ID NO: 32980 - protein, 116 aa, Homo sapiens
ISGKQSILSVRLEQCPLQLNNPFNEYSKFDGKGHVGTTATKKIDVYLPLHSSQDRLLPMTVVTMASARVQDLIGLICWQYTSEGREPKLNSKIRTTPKRETKPDQMQKYSVERKKF

SEQ ID NO: 32981 - protein, 15 aa, Homo sapiens
ITLLTSIPNLMARVM

SEQ ID NO: 32982 - protein, 249 aa, Homo sapiens
QEMDGQKKNWKDKVVDLLYWRDIKKTGVVFGASLFLLLSLTVFSIVSVTAYIALALLSVTISFRIYKGVIQAIQKSDEGHPFRAYLESEVAISEELVQKYSNSALGHVNCTIKELRRLFLVDDLVDSLKNIQPKVEEKISFSDDFSKNGSATSKVLLLPPDVSALATQAEIESIVKPKVLVKEAEKKLPSDTEKEDRSPSAIFSAELSKTSGNPIYMQFCAFMPLLDLGNIPLHFVFYIMFIVSHMSHW

SEQ ID NO: 32983 - protein, 94 aa, Homo sapiens
MASSNPPPQPAIGDQLVPGVPGPSSEAEDDPGEAFEFDDSDDEEDTSAALGVPSLAPERDTDPPLIHLDSIPVTDPDPAAAPPGTGCVAGTVLV

SEQ ID NO: 32984 - protein, 39 aa, Homo sapiens
VCSWDGAGLSWTLSDGFLQPSSTACHRRSAGSRSPRPLL

SEQ ID NO: 32985 - protein, 9 aa, Homo sapiens
GRGRPRRGV

SEQ ID NO: 32986 - protein, 11 aa, Homo sapiens
LGRCWSELDLV

SEQ ID NO: 32987 - protein, 36 aa, Homo sapiens
MGMQRTQPSPGPGTPAGSGRVPVALTGSLSPPWKRM

SEQ ID NO: 32988 - protein, 764 aa, Homo sapiens
AGPCLMASSNPPPQPAIGDQLVPGVPGPSSEAEDDPGEAFEFDDSDDEEDTSAALGVPSLAPERDTDPPLIHLDSIPVTDPDPAAAPPGTGVPAWVSNGDAADAAFSGARHSSWKRKSSRRIDRFTFPALEEDVIYDDVPCESPDAHQPGAERNLLYEDAHRAGAPRQAEDLGWSSSEFESYSEDSGEEAKPEVEVEPAKHRVSFQPKLSPDLTRLKERYARTKRDILALRVGGRDMQELKHKYDCKMTQLMKAAKSGTKDGLEKTRMAVMRKVSFLHRKDVLGDSEEEDMGLLEVSVSDIKPPAPELGPMPEGLSPQQVVRRHILGSIVQSEGSYVESLKRILQDYRNPLMEMEPKALSARKCQVVFFRVKEILHCHSMFQIALSSRVAEWDSTEKIGDLFVASFSKSMVLDVYSDYVNNFTSAMSIIKKACLTKPAFLEFLKRRQVCSPDRVTLYGLMVKPIQRFPQFILLLQDMLKNTPRGHPDRLSLQLALTELETLAEKLNEQKRLADQVAEIQQLTKSVSDRSSLNKLLTSGQRQLLLCETLTETVYGDRGQLIKSKERRVFLLNDMLVCANINFKPANHRGQLEISSLVPLGPKYVVKWNTALPQVQVVEVGQDGGTYDKDNVLIQHSGAKKASASGQAQNKVYLGPPRLFQELQDLQKDLAVVEQITLLISTLHGTYQNLNMTVAQDWCLALQRLMRVKEEEIHSANKCRLRLLLPGKPDKSGRPISFMVVFITPNPLSKISWVNRLHLAKIGLRV

SEQ ID NO: 32989 - protein, 66 aa, Homo sapiens
MLDGNSGLSSEKISHNPWSLRCHKQQLSRMRSESKDRKLYSILVAPPSGVSTGSIGRVLGHHSAYG

SEQ ID NO: 32990 - protein, 18 aa, Homo sapiens
MESKRLRLLQEEDRRKKV

SEQ ID NO: 32991 - protein, 91 aa, Homo sapiens
QLQPPDEREHPAEGDGEQETAAAPGRRQTEKGLTPGQHSPLTIPATVMTSLRQPRLAQLGPPLCQSYLGFTLTLKRNATSACSLDITTATP

SEQ ID NO: 32992 - protein, 8 aa, Homo sapiens
MMPLSSMS

SEQ ID NO: 32993 - protein, 76 aa, Homo sapiens
RTTGEAASPLTVCPPDGTQTRIPRMPMTQAVSHLRGASRTVPLTPTPSASMPVPGRPPRLPRSSATSPMETTATLP

SEQ ID NO: 32994 - protein, 50 aa, Homo sapiens
LHSASAKRGAQSRYQIPVHRGSGRGRLAKQRPLSQYVLPTGHRLGYPGCQ

SEQ ID NO: 32995 - protein, 165 aa, Homo sapiens
MSSRRDTDSDTQDANDSSCKSSERSLPDCTPHPNSISIDAGPRQAPKIAQIKRNLSYGDNSDPALEASSLPPPDPWLETSSSSPAEPAQPGACRRDGYWFLKLLQAETERLEGWCCQMDKETKENNLSEEGCVRHCVISQALSRPLFSTNRPGSRKPVEFSLFHR

SEQ ID NO: 32996 - protein, 104 aa, Homo sapiens
AIHGLFSCTSPPFCYQESQSGCFQGLSSVMALGLKCFRMVHPTFRNYLAASIRPVSEVTLKTVHERQHGHRQYMAYSAVPVRHFATKKAKVDVSKDCLQSWPWD

SEQ ID NO: 32997 - protein, 27 aa, Homo sapiens
KKHVQSQRLSIASSSPTHLQATSSRSV

SEQ ID NO: 32998 - protein, 8 aa, Homo sapiens
AEEMNEMK

SEQ ID NO: 32999 - protein, 1039 aa, Homo sapiens
MDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTEEEEYPGITAEDSNDIYILPSDNSGQVSPPESPTVTTSWQSESLPVSLSASQSWHTESLPVSLGPESWQQIAMDPEEVKSLDSNGAGEKSENNSSNSDIVHVEKEEVPEGMEEAAVASVVLPARELQEALPEAPAPLLPHITATSLLGTREPDTEVITVEKSSPATSLFVELDEEEVKAATTEPTE

SEQ ID NO: 33000 - protein, 14 aa, Homo sapiens
ALSPGSRLQWILKK

SEQ ID NO: 33001 - protein, 13 aa, Homo sapiens
IKYLEYKEIRKVD

SEQ ID NO: 33002 - protein, 42 aa, Homo sapiens
LKMGRKKIQITRIMDERNRQELHFVKKEQEFSARIISKCTFC

SEQ ID NO: 33003 - protein, 297 aa, Homo sapiens
MDERNRQVTFTKRKFGLMKKAYELSVLCDCEIALIIFNSSNKLFQYASTDMDKVLLKYTEYNEPHESRTNSDIVETLRKKGLNGCESPDADDYFEHSPLSEDRFSKLNEDSDFIFKRGPPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLELHFVKKEQEFSARIISKCTFC

SEQ ID NO: 33004 - protein, 16 aa, Homo sapiens
LPRKAKVEQLDLWLST

SEQ ID NO: 33005 - protein, 12 aa, Homo sapiens
MKNLALSIVKKN

SEQ ID NO: 33006 - protein, 25 aa, Homo sapiens
VTAKEGKGRATGSLALHIASDLRPY

SEQ ID NO: 33007 - protein, 247 aa, Homo sapiens
MNEKSCSFHSKEELRDGQGERLSAGYSPSYDKDKSVLAFRGIPISELKNHGILQALTTEAYEWEPRVVSTEVVRAQEEWEAVDTIQPETGSQASSEQPGQLISFSEALQHFQTVDLSPFKKRIQPTIRRTGLAALRHYLFGPPKLHQRLREERDLVLTIAQCGLDSQDPVHGRVLQTIYKKLTGSKFDCALHGNHWEDLGFQGANPATDLRGAGFLALLHLLYLVMDSKTLPMAQEIFRLSRHHIQS

SEQ ID NO: 33008 - protein, 113 aa, Homo sapiens
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKVGLSKSDPK

SEQ ID NO: 33009 - protein, 22 aa, Homo sapiens
AAIPAGQMERGAREMAAPGDCA

SEQ ID NO: 33010 - protein, 56 aa, Homo sapiens
LQSLLGRWREEQGRWQPRGTVHREGLMKWQLSPVQWPPVSQGPETRKGRKAASLPL

SEQ ID NO: 33011 - protein, 52 aa, Homo sapiens
ALSSGHPSAKGQRPGKEERQLHFLFEDGVAQPRWKEQKICKISVHLQVPDAL

SEQ ID NO: 33012 - protein, 11 aa, Homo sapiens
MLVYHRKLLKN

SEQ ID NO: 33013 - protein, 49 aa, Homo sapiens
MEDHLQIPFIQVSSLLLALRYLWERSQEIYLRMNLFHYLRKLDLYGIFV

SEQ ID NO: 33014 - protein, 10 aa, Homo sapiens
GTLGKNRLHT

SEQ ID NO: 33015 - protein, 62 aa, Homo sapiens
MGERKGVNKYYPPDFNPEKHGSLNRYHNSHPLRERARKLSQGILIIRHAAFWMPPMPGGSLV

SEQ ID NO: 33016 - protein, 53 aa, Homo sapiens
AWRESCLSWHHHTAHDIFAGKPVDPLPGSTRGQDSAVCSQGQFLIVRPEAEDQ

SEQ ID NO: 33017 - protein, 66 aa, Homo sapiens
AAPKMGERKGVNKYYPPDFNPEKHGSLNRYHNSHPLRERARKLSQGILIIRHAAFWMPPMPGGSLV

SEQ ID NO: 33018 - protein, 36 aa, Homo sapiens
AGTTTRPTTSSQGSLWTLCQAPQEVRTVQCVHKASF

SEQ ID NO: 33019 - protein, 49 aa, Homo sapiens
LAGVLSELAPPHGPRHLRREACGPSARLHKRSGQCSVFTRPVSDRPPRG

SEQ ID NO: 33020 - protein, 126 aa, Homo sapiens
MPEPAKSAPAPKKGSKKAVTKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 33021 - protein, 27 aa, Homo sapiens
GLQTWTVSHCQASRAPTCRRPVVGQSL

SEQ ID NO: 33022 - protein, 1671 aa, Homo sapiens
MEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIK

SEQ ID NO: 33023 - protein, 1729 aa, Homo sapiens
AGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIKQHSKLAGLWSPGLVPAAPRTENYTIGPLALRPSDLDCVTLPGFQGSNLQTACCGTVSVIAKATMEDLGENTMVLSTLRSLNNFISQRVEGGSGLDISTSAPGSLQMQYQQSMQLEERAEQIRSKSHLIQVEREKMQMELSHKRARVELERAASTSARNYEREVDRNQELLTRIRQLQEREAGAEEKMQEQLERNRQCQQNLDAASKRLREKEDSLAQAGETINALKGRISELQWSVMDQEMRVKRLESEKQELQEQLDLQHKKCQEANQKIQELQASQEARADHEQQIK

SEQ ID NO: 33024 - protein, 168 aa, Homo sapiens
MYCCSAQDSKMDYKRRFLLGGSKQKVQQHQQYPMPELGRALSAPLASTATTAPLGSLTAAGSCHHAMPHTTPIADIQQGISKYLDALNVFCRASTFLTDLFSTVFRNSHYSKAATQLKDVQEHVMEAASRLTSAIKPEIAKMLMELSAGAANFTDQKEFSLQDIEERT

SEQ ID NO: 33025 - protein, 33 aa, Homo sapiens
LLSLTSTLDHMVTCLMEMPFLKLRFAELHYFYT

SEQ ID NO: 33026 - protein, 220 aa, Homo sapiens
MTDNSNNQLVVRAKFNFQQTNEDELSFSKGDVIHVTRVEEGGWWEGTLNGRTGWFPSNYVREVKASEKPVSPKSGTLKSPPKGFDTTAINKSYYNVVLQNILETENEYSKELQTVLSTYLRPLQTSEKLSSANISYLMGNLEEICSFQQMLVQSLEECTKLPEAQQRVGGCFLNLMPQMKTLYLTYCANHPSAVNVLTEHRRLMQMICIRGRILTRSSVP

SEQ ID NO: 33027 - protein, 74 aa, Homo sapiens [sequence omitted]

SEQ ID NO: 33028 - protein, 54 aa, Homo sapiens
IATQDDERLRWRRLPQPLPPRSKKPKVGSWRPLASPTRVKRPLLWWWLQRQQQR

SEQ ID NO: 33029 - protein, 13 aa, Homo sapiens
LPKEVTGFHPETT

SEQ ID NO: 33030 - protein, 8 aa, Homo sapiens
LPPRTMSG

SEQ ID NO: 33031 - protein, 309 aa, Homo sapiens
MEEMEEELKCPVCGSFYREPIILPCSHNLCQACARNILVQTPESESPQSHRAAGSGVSDYDYLDLDKMSLYSEADSGYGSYGGFASAPTTPCQKSPNGVRVFPPAMPPPATHLSPALAPVPRNSCITCPQCHRSLILDDRGLRGFPKNRVLEGVIDRYQQSKAAALKCQLCEKAPKEATVMCEQCDVFYCDPCRLRCHPPRGPLAKHRLVPPAQGRVSRRLSPRKVSTCTDHELENHSMYCVQCKMPVCYQCLEEGKHSSHEVKALGAMWKLHKGLTLESPPHHAPRWKKQKGTRCCKLWQMPRARGVE

SEQ ID NO: 33032 - protein, 251 aa, Homo sapiens [sequence omitted]

SEQ ID NO: 33033 - protein, 32 aa, Homo sapiens
LSLQPDPGSWKNHVRQLLVMPGTHCCPRGAAV

SEQ ID NO: 33034 - protein, 276 aa, Homo sapiens
IICECWEEECQSCRLKITQPREICRMDFLVLFLFYLASVLMGLVLICVCSKTHSLKGLARGGAQIFSCIIPECLQRAVHGLLHYLFHTRNHTFIVLHLVLQGMVYTEYTWEVFGYCQELELSLHYLLLPYLLLGVNLFFFTLTCGTNPGIITKANELLFLHVYEFDEVMFPKNVRCSTCDLRKPARSKHCSVCNWCVHRFDHHCVWVNNCIGAWNIRYFLIYVLTLTASAATVAIVSTTFLVHLVVMSDLYQETYIDDLGHLHVMDTVFLIQVFCL

SEQ ID NO: 33035 - protein, 49 aa, Homo sapiens
MLGRGMPELPAENYPTKRNLQDGLSGPLLVLPGFGADGSCSYLRLLENP

SEQ ID NO: 33036 - protein, 51 aa, Homo sapiens
MYTLESGLIGKKLLAQWQNENKKILRTKKEDYRPVPPMNIDAKILNKILVN

SEQ ID NO: 33037 - protein, 77 aa, Homo sapiens
METESESSTLGDDSVFWLESEVIIQVTDCEEEEREEKFRKMKSSVHSEEDDFVPELHRNVHPRERPDWEETLSAMAK

SEQ ID NO: 33038 - protein, 14 aa, Homo sapiens
LTVKRKKGKRSSGR

SEQ ID NO: 33039 - protein, 11 aa, Homo sapiens
MQLCVPLRPRN

SEQ ID NO: 33040 - protein, 8 aa, Homo sapiens
APPPRRRP

SEQ ID NO: 33041 - protein, 20 aa, Homo sapiens
ALPWPLCSVRTRRTSRVSWL

SEQ ID NO: 33042 - protein, 24 aa, Homo sapiens
MRSPGTHRACWRPLTPTASRRSGP

SEQ ID NO: 33043 - protein, 45 aa, Homo sapiens
AVGSCVAGPGAAGGAAAASEALGLGPVPYRLERVHPAAHPQPAHG

SEQ ID NO: 33044 - protein, 199 aa, Homo sapiens
LLAAVLLGLVLLVVLLLLLRHWGWGLCLIGWNEFILQPIHNLLMGDTKEQRILNHVLQHAEPGNAQSVLEAIDTYCEQKEWAMNVGDKKGKIVDAVIQEHQPSVLLELGAYCGYSAVRMARLLSPGARLITIEINPDCAAITQRMVDFAGVKDKVTLVVGASQDIIPQLKKKYDVDTLDMVFLDHWKDRYLPDTLLLEK

SEQ ID NO: 33045 - protein, 33 aa, Homo sapiens
GTGAGACALSAGTSSSCSPSTTCSWVTPRSSAS

SEQ ID NO: 33046 - protein, 529 aa, Homo sapiens [sequence omitted]

SEQ ID NO: 33047 - protein, 563 aa, Homo sapiens
AWLSAWTQRFRLPGFLVVFRISGKSVQAFSVGAGMDDKGDPSNEEAPKAIKPTSKEFRKTWGFRRTTIAKREGAGDAEADPLEPPPPQQQLGLSLRRSGRQPKRTERVEQFLTIARRRGRRSMPVSLEDSGEPTSCPATDAETASEGSVESASETRSGPQSASTAVKERPASSEKVKGGDDHDDTSDSDSDGLTLKELQNRLRRKREQEPTERPLKGIQSRLRKKRREEGPAETVGSEASDTVEGVLPSKQEPENDQGVVSQAGKDDRESKLEGKAAQDIKDEEPGDLGRPKPECEGYDPNALYCICRQPHNNRFMICCDRCEEWFHGDCVGISEARGRLLERNGEDYICPNCTILQVQDETHSETADQQEAKWRPGDADGTDCTSIGTIEQKSSEDQGIKGRIEKAANPSGKKKLKIFQPVIEAPGASKCIGPGCCHVAQPDSVYCSNDCILKHAAATMKFLSSGKEQKPKPKEKMKMKPEKPSLPKCGAQAGIKISSVHKRPAPEKKETTVKKAVVVPARSEALGKEAACESSTPSWASDHNYNAVKPEKTAAPSPSLLYK

SEQ ID NO: 33048 - protein, 117 aa, Homo sapiens
QQCCCEPGCLLGPRGFVCQGFWLYLGFQGKVSKLSVLEQVWTTKATRAMRRHLRPSNPPAKSSGKHGVFEGPLSPSERAQGTRRLTHWSRHPHSSSWACPCGAVGGSPSALSAWSSS

SEQ ID NO: 33049 - protein, 288 aa, Homo sapiens
MAGVGRSGGPWGRTRGGRSGRLGVSLGALSSLPLEELPRPLCCRRCRRHFGFALRGETIPVSVAGSASSQFAPLALHLSLLLSRISASRLTRWPPPDKREGSAVDPGKRRSLAATPSSSLPCTLIALGLRHEKEANELMEDLFETFQDEMGFSNMEDDGPEEEERVAEPQANFNTPQALRFEELLANLLNEQHQIAKELFEQLKMKKPSAKQQKEVEKVKPQCKEVHQTLILDPAQRKRLQQQMQQHVQLLTQIHLLATCNPNLNPEATTTRIFLVSFQISITLKTRV

SEQ ID NO: 33050 - protein, 70 aa, Homo sapiens
MMRQAPTARKTTTRRPKPTRPASTGVAGASSSLGPSGSASAGDWKRPPRHCGLCWSHTVCHWQMGRRDSG

SEQ ID NO: 33051 - protein, 445 aa, Homo sapiens
MSTSLGSNLSELDRLLLELNAVQHNPPGFPADEANSSPPLPGALSPLYGVPETNSPLGGKAGPLTKEKPKRNGGRGLEDVRPSVESLLDELESSVPSPVPAITVNQGEMSSPQRVTSTQQQTRISASSATRELDELMASLSDFKGSWPLEEVVLLVSISSSVQEGEKYPHPCAARHRTPSLRSPDQPPPCPQFMAQGKTGSSSPPGGPPKPGSQLDSMLGSLQSDLNKLGVATVAKGVCGACKKPIAGQVVTAMGKTWHPEHFVCTHCQEEIGSRNFFERDGQPYCEKDYHNLFSPRCYYCNGPILDKVVTALDRTWHPEHFFCAQCGAFFGPEGFHEKDGKAYCRKDYFDMFAPKCGGCARAILENYISALNTLWHPECFVCRTPCWRTWSLPPPTSPNGLCSCRRRPPTHTQLETTHTRRLPCHPPSPHPRPARPSMAQSLTP

SEQ ID NO: 33052 - protein, 17 aa, Homo sapiens
ARPWAATFLNSTACCWN

SEQ ID NO: 33053 - protein, 15 aa, Homo sapiens
AFTHRNEHVPGQQPF

SEQ ID NO: 33054 - protein, 83 aa, Homo sapiens
METVTCSWRESTCTTMRLLVTNMYLGPSWWIWSLAPWTLSGLDPSARSSDQTTSCSARAEPGITGPRATTQREPSWSTRSWMW

SEQ ID NO: 33055 - protein, 13 aa, Homo sapiens
AWDRPHRQLPWRQ

SEQ ID NO: 33056 - protein, 260 aa, Homo sapiens
GRSLRSPARRSTPRTAPRASATRSAAGTMREIVHIQAGQCGNQIGAKFWEVISDEHGIDPTGSYHGDSDLQLERINVYYNEAAGNKYVPRAILVDLEPGTMDSVRSGPFGQIFRPDNFVFGQSGAGNNWAKGHYTEGAELVDSVLDVVRKESESCDCLQGFQLTHSLGGGTGSGMGTLLISKIREEYPDRIMNSFSVMPSPKVSDTVVEPYNATLSVHQLVENTDETYCIDNEALYDICFRTLKLTTPTYGTSTTWCRPP

SEQ ID NO: 33057 - protein, 22 aa, Homo sapiens
MQKPAAMVTLITHLVQHLTGRA

SEQ ID NO: 33058 - protein, 79 aa, Homo sapiens
MQKPAAMEKMSTLVLVMGSQKILGPFLKWKRSSSVQLKVVTGHLYGQLTLNTTSRLIEMTAPSSVLQKVVGKASMCCRG

SEQ ID NO: 33059 - protein, 89 aa, Homo sapiens
LLLLVHNWQRMQKPAAMEKMSTLVLVMGSQKILGPFLKWKRSSSVQLKVVTGHLYGQLTLNTTSRLIAPGTVCSEYVHPIGTGACRIRS

SEQ ID NO: 33060 - protein, 637 aa, Homo sapiens
MQELEELRKQLGSVATGSTLQQSLELKRKMLRDKQNKKNSGQHLPIFPAWVYERPALIGDFLIGAGISTDTALPIGTLPLASQESAVVEDLLYVLVGVDGRYVSAQPLAGRQSRTFLVDPNLDLSIRELVHRILPVAASYSAVTRFIEEKSSFEYGQVNHALAAAMRTLVKEHLILVSQLEQLHRQGLLSLQKLWFYIQPAMRTMDILASLATSVDKGECLGGSTLSLLHDRSFSYTGDSQAQELCLYLTKAASAPYFEVLEKWIYRGIIHDPYSEFMVEEHELRKERIQEDYNDKYWDQRYTIVQQQIPSFLQKMADKILSTGKYLNVVRECGHDVTCPVAKEIIYTLKERAYVEQIEKAFNYASKVLLDFLMEEKELVAHLRSIKRYFLMDQGDFFVHFMDLAEEELRKPVEDITPPRLEALLELALRMSTANTDPFKDDLKIDLMPHDLITQLLRVLAIETKQEKAMAHADPTELALSGLEAFSFDYIVKWPLSLIINRKALTRYQMLFRHMFYCKHVERQLCSVWISNKTAKQHSLHSAQWFAGAFTLRQRMLNFVQNIQYYMMFEVMEPTWHILEKNLKSASNIDDVLGHHTGFLDTCLKDCMLTNPELLKVFSKLMSVCVMFTNCMQENIL

SEQ ID NO: 33061 - protein, 27 aa, Homo sapiens
ACSRCCGQQYHQHQRPCRGLQDLHAGA

SEQ ID NO: 33062 - protein, 197 aa, Homo sapiens
MSPGCMLLFVFGFVGGAVVINSAILVSLSVLLLVHFSISTGVPALTQNLPRILRKERPISLGIFPLPAGDGLLTPDAQKGGETPGSEQWKFQELSQPRSHTSLKAYQQSDGAEDNRDGRCSKLGKGHQSQEVSSDFEPAEQVALPALILSSCFLERRIERALKMRLKYLHHYSKGEILDLSFDCSFFLPPHLFFLFR

SEQ ID NO: 33063 - protein, 14 aa, Homo sapiens
MTDPHYKDTPLAPV

SEQ ID NO: 33064 - protein, 14 aa, Homo sapiens
ASLVRVFHHASTAP

SEQ ID NO: 33065 - protein, 55 aa, Homo sapiens
MIPAMAWIHRKQGLGFHLTSEMMRKLQAWRQNQREVREKKQGHLSLLKSCFHCLL

SEQ ID NO: 33066 - protein, 498 aa, Homo sapiens
MENVDNSLDGSDVSEPAKPEAGLEVAQSILSKFSMKSLFGFTSKLESVNPEEEDAVLKAFHSLDVNPTSQQDDSSNGLDPQEAGSRVSPDLGNDEKIASVETESEGSQRKEAGTSLLAQELLPLSTLKGTKDDVICVRGTLVHTTSDSDSDDGGQEPEEGSSTNGPKSPSGVLSEPSQESKENPGGFRENTVTGEMNGAELCAEDPQRIPPEMSSKLEAGNGGLQTERRPSQDQVGEEGSQDLPAVTNQNSSVGITESASSKKEVSGEKSFQLPAFFSGLRVLKKGATAEGGETITEIKPKDGDLALLKLTQPVQKSLVQAGLQTVKSEKKATDPKATPTLLEQLSLLLNIDMPKTEPKGADPESPRREEMGCNADQESQSGPGVPQTQGGEVKPKSPETALEAFKALFIRPPRKGTTADTSELEALKRKMRHEKESLRAVFERSNSKPADGPSDSKSPDHSLTEQDDRTPGRLQAVWPPPKTKDTEEKVGLKYTEAG

SEQ ID NO: 33067 - protein, 8 aa, Homo sapiens
IQKRKMLC

SEQ ID NO: 33068 - protein, 17 aa, Homo sapiens
IRICESRRGRCCAESIP

SEQ ID NO: 33069 - protein, 306 aa, Homo sapiens
MGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSS

SEQ ID NO: 33070 - protein, 30 aa, Homo sapiens
RFLRLHPHWLSLLNQTPSSEDFWLIFQKAQ

SEQ ID NO: 33071 - protein, 26 aa, Homo sapiens
AMRSSQICPKQFHSQWDCIWERQKQK

SEQ ID NO: 33072 - protein, 298 aa, Homo sapiens
MGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSS

SEQ ID NO: 33073 - protein, 356 aa, Homo sapiens
KVSASSPSLAVASQSDSKQRRLLVDFPKGSVSNAQQPDLSKAVSLSMGLYMGETETKVMGNDLGFPQQGQISLSSGETDLKLLEESIANLNRSTSVPENPKSSASTAVSAAPTEKEFPKTHSDVSSEQQHLKGQTGTNGGNVKLYTTDQSTFDILQDLEFSSGSPGKETNESPWRSDLLIDENCLLSPLAGEDDSFLLEGNSNEDCKPLILPDTKPKIKDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSS

SEQ ID NO: 33074 - protein, 80 aa, Homo sapiens
MSAISVHGVSTSGGQMYHYDMNTASLSQQQDQKPIFNVIPPIPVGSENWNRCQGSGDDNLTSLGTLNFPGRTVFSNGYSS

SEQ ID NO: 33075 - protein, 138 aa, Homo sapiens
KDNGDLVLSSPSNVTLPQVKTEKEDFIELCTPGVIKQEKLGTVYCQASFPGANIIGNKMSAISVHGVSTSGGQMYHYDMNTASLSQQQDQKPIFNVIPPIPVGSENWNRCQGSGDDNLTSLGTLNFPGRTVFSNGYSS

SEQ ID NO: 33076 - protein, 13 aa, Homo sapiens
RIMEIWFCQAPVM

SEQ ID NO: 33077 - protein, 12 aa, Homo sapiens
LVIKCLPFLFMV

SEQ ID NO: 33078 - protein, 20 aa, Homo sapiens
ARETGHSLLSGKLSWSKYNW

SEQ ID NO: 33079 - protein, 60 aa, Homo sapiens
MNTASLSQQQDQKPIFNVIPPIPVGSENWNRCQGSGDDNLTSLGTLNFPGRTVFSNGYSS

SEQ ID NO: 33080 - protein, 38 aa, Homo sapiens
IQHPFLNSRIRSLFLMSFHQFPLVPKIGIGAKDLEMTT

SEQ ID NO: 33081 - protein, 85 aa, Homo sapiens
AAIQKSLKDPSNNFRLHNGRSKEQRLKEQLGAQQEPVKKSIQESEAFLPQSIPEERYKMKSKPLGICLIIDCIGNETELPHWKGF

SEQ ID NO: 33082 - protein, 10 aa, Homo sapiens
MTMKHGQKMT

SEQ ID NO: 33083 - protein, 471 aa, Homo sapiens
IMGCVQCKDKEATKLTEERDGSLNQSSGYRYGTDPTPQHYPSFGVTSIPNYNNFHAAGGQGLTVFGGVNSSSHTGTLRTRGGTGVTLFVALYDYEARTEDDLSFHKGEKFQILNSSEGDWWEARSLTTGETGYIPSNYVAPVDSIQAEEWYFGKLGRKDAERQLLSFGNPRGTFLIRESETTKGAYSLSIRDWDDMKGDHVKHYKIRKLDNGGYYITTRAQFETLQQLVQHYSERAAGLCCRLVVPCHKGMPRLTDLSVKTKDVWEIPRESLQLIKRLGNGQFGEVWMGTWNGNTKVAIKTLKPGTMSPESFLEEAQIMKKLKHDKLVQLYAVVSEEPIYIVTEYMNKGSLLDFLKDGEGRALKLPNLVDMAAQVAAGMAYIERMNYIHRDLRSANILVGNGLICKIADFGLARLIEDNEYTARQGAKFPIKWTAPEAALYGRFTIKSDVWSFGILLTELVTKGRVPYPGI

SEQ ID NO: 33084 - protein, 107 aa, Homo sapiens
MENCLGESRHEVEKSEISENTDASGKIEKYNVPLNRLKMMFEKGEPTQTKILRAQSRSASGRKISENSYSLDDLEIGPGTRKQLKKQTWRRREVTPKISPSTLERGP

SEQ ID NO: 33085 - protein, 56 aa, Homo sapiens
QATLLLEPKLTKKNKSTPDLDSGHLLKPSFRVDIPTSRTVRILKTTQQKVKKWKIV

SEQ ID NO: 33086 - protein, 9 aa, Homo sapiens
AQWKRILTQ

SEQ ID NO: 33087 - protein, 17 aa, Homo sapiens
LIHPLSRFEYEHSGRGF

SEQ ID NO: 33088 - protein, 133 aa, Homo sapiens
MRECISIHVGQAGVQIGNACWELYCLEHGIQPDGQMPSDKTIGGGDDSFNTFFSETGAGKHVPRAVFVDLEPTVIDEVRTGTYRQLFHPEQLITGKEDAANNYARGHYTIGKEIIDLVLDRIRKLVCFFSRIK

SEQ ID NO: 33089 - protein, 787 aa, Homo sapiens
MYGTRCHGCGEFVEGEVVTALGKTYHPNCFACTICKRPFPPGDRVTFNGRDCLCQLCAQPMSSSPKETTFSSMAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSMAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSMAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSMAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSMAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSS

SEQ ID NO: 33090 - protein, 109 aa, Homo sapiens
AKVDNEILDYKDLAAIPKVKAIYDIERPDLITYEPFYTSGYDDKQERQSLGESPRTLSPTPSAEGYQDVRDRMIHRSTSQGSINSPVYSRHSYTPTTSRSPQHFHRPGR

SEQ ID NO: 33091 - protein, 130 aa, Homo sapiens
QTGETEPWRVSEDFVSYSISRRVPGCSGSDDPSVHEPGLHQLPCVQPPQLHSNHVPLSPAFPQTWQVTNITTPAVHDAADATRCSQKERKCIFKAPPFGIPTVSNLRRPRKSCGCQTFGVLHPISFIPKV

SEQ ID NO: 33092 - protein, 109 aa, Homo sapiens
RGLLHKERRVSLHPGLPADVRDTLPWLWGVRGGRSGDCSGQDLPSQLLCLYYLQAPVSTRRPSHIQWERLPLSTLCTADVVQSERNHLLQHGPPSGPSPPIREACHSLP

SEQ ID NO: 33093 - protein, 83 aa, Homo sapiens
MGETAFVNSVHSRCRPVRKKPPSPAIVPAAEEISRMGRRCWRWISSGTWGALNASPAGRSSPGSTSARMVLRTVKRTTRDSLG

SEQ ID NO: 33094 - protein, 112 aa, Homo sapiens
LLWARPTIPIALLVLSASARFHPETESHSMGETAFVNSVHSRCRPVRKKPPSPAIVPAAEEISRMGRRCWRWISSGTWGALNASPAGRSSPGSTSARMVLRTVKRTTRDSLG

SEQ ID NO: 33095 - protein, 10 aa, Homo sapiens
AHQVILSMQK

SEQ ID NO: 33096 - protein, 3081 aa, Homo sapiens
MEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTK

SEQ ID NO: 33097 - protein, 10 aa, Homo sapiens
AERRAAAQVD

SEQ ID NO: 33098 - protein, 2961 aa, Homo sapiens
MAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTKGLASVFSNRTSRKSALRAGNDSAMADGEGYRNPTEVQMSQLVLPCHTNQRGELSVGQLLKWIDTTACLSAERHAGCPCVTASMDDIYFEHTISVGQVVNIKAKVNRAFNSSMEVGIQVASEDLCSEKQWNVCKALATFVARREITKVKLKQITPRTEEEKMEHSVAAERRRMRLVYADTIKDLLANCAIQGDLESRDCSRMVPAEKTRVESVELVLPPHANHQGNTFGGQIMAWMENVATIAASRLCRAHPTLKAIEMFHFRGPSQVGDRLVLKAIVNNAFKHSMEVGVCVEAYRQEAETHRRHINSAFMTFVVLDADDQPQLLPWIRPQPGDGERRYREASARKKIRLDRKYIVSCKQTEVPLSVPWDPSNQVYLSYNNVSSLKMLVAKDNWVLSSEISQVRLYTLEDDKFLSFHMEMVVHVDAAQAFLLLSDLRQRPEWDKHYRSVELVQQVDEDDAIYHVTSPALGGHTKPQDFVILASRRKPCDNGDPYVIALRSVTLPTHRETPEYRRGETLCSGFCLWREGDQLTK

SEQ ID NO: 33099 - protein, 112 aa, Homo sapiens
MTTASLTLRWKWPMRANTMPTATSSACVATTPSVPGHRAGPGMPGAAGQWPQAMGACGKTPWGPGASACLVPLGCPPSSPRTSSPSTACSRACEVGAPSRAAPALVSGLAMA

SEQ ID NO: 33100 - protein, 9 aa, Homo sapiens
IWCRIWRQT

SEQ ID NO: 33101 - protein, 121 aa, Homo sapiens
VSATCTGQAMTTASLTLRWKWPMRANTMPTATSSACVATTPSVPGHRAGPGMPGAAGQWPQAMGACGKTPWGPGASACLVPLGCPPSSPRTSSPSTACSRACEVGAPSRAAPALVSGLAMA

SEQ ID NO: 33102 - protein, 407 aa, Homo sapiens
MWEDPMGARGQCMSGASRLPSLFSQNIIPEYGMFQGMRGGGAFPGGSRFGFGFGNGMKQMRRTWKTWTTADFRTKKKKRKQGGSPDEPDSKATRTDCSDNSDSDNDEGTEGEATEGLEGTEAVEKGSRVDGEDEEGKEDGREEGKEDPEKGALTTQDENGQTKRKLQAGKKSQDKQKKRQRDRMVERIQFVCSLCKYRTFYEDEMASHLDSKFHKEHFKYVGTKLPKQTADFLQEYVTNKTKKTEELRKTVEDLDGLIHQIYRDQDLTQEIAMEHFVKKVEAAHCAACDLFIPMQFGIIQKHLKTMDHNRNRRALSRDLKPLCSRHTRIPALSPPVIMDMELGTLGQIEATRAMAMAMAMARITPPTMGMVWPLHTLGKCLALTQMQTLVPRVAPVPIPFYPELTSA

SEQ ID NO: 33103 - protein, 84 aa, Homo sapiens
VGRPHGGPGPVHVWCLSAALPLLPEHHPRVRHVPGHARWGRLPGRLPLWFRVWQWHEADEADLEDLDHSRLPNQEEEEKAGRQS

SEQ ID NO: 33104 - protein, 12 aa, Homo sapiens
RLWEVCISCRSC

SEQ ID NO: 33105 - protein, 10 aa, Homo sapiens
LQKLLEIIPF

SEQ ID NO: 33106 - protein, 21 aa, Homo sapiens
KVVSQGECIGFQLGNKTNLGF

SEQ ID NO: 33107 - protein, 592 aa, Homo sapiens
MLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIF

SEQ ID NO: 33108 - protein, 666 aa, Homo sapiens
GCGKSVLAAEAVRDHSLLEGCFPGGVHWVSVGKQDKSGLLMKLQNLCTRLDQDESFSQRLPLNIEEAKDRLRILMLRKHPRSLLILDDVWDSWVLKAFDSQCQILLTTRDKSVTDSVMGPKYVVPVESSLGKEKGLEILSLFVNMKKADLPEQAHSIIKECKGSPLVVSLIGALLRDFPNRWEYYLKQLQNKQFKRIRKSSSYDYEALDEAMSISVEMLREDIKDYYTDLSILQKDVKVPTKVLCILWDMETEEVEDILQEFVNKSLLFCDRNGKSFRYYLHDLQVDFLTEKNCSQLQDLHKKIITQFQRYHQPHTLSPDQEDCMYWYNFLAYHMASAKMHKELCALMFSLDWIKAKTELVGPAHLIHEFVEYRHILDEKDCAVSENFQEFLSLNGHLLGRQPFPNIVQLGLCEPETSEVYQQAKLQAKQEVDNGMLYLEWINKKNITNLSRLVVRPHTDAVYHACFSEDGQRIASCGADKTLQVFKAETGEKLLEIKAHEDEVLCCAFSTDDRFIATCSVDKKVKIWNSMTGELVHTYDEHSEQVNCCHFTNSSHHLLLATGSSDCFLKLWDLNQKECRNTMFGHTNSVNHCRFSPDDKLLASCSADGTLKLWDATSANERKSINVKQFFLNLEDPQEDMEVIVKCCSWSADGARIMVAAKNKIF

SEQ ID NO: 33109 - protein, 15 aa, Homo sapiens
LLCSIAFITKVFVVG

SEQ ID NO: 33110 - protein, 24 aa, Homo sapiens
MNIRRQCSPKIRILYHLLINTGSA

SEQ ID NO: 33111 - protein, 8 aa, Homo sapiens
IPHPVYLS

SEQ ID NO: 33112 - protein, 10 aa, Homo sapiens
RKCALVLWPT

SEQ ID NO: 33113 - protein, 10 aa, Homo sapiens
QPKTEQCCVY

SEQ ID NO: 33114 - protein, 41 aa, Homo sapiens
MEGPQGPPRRPGVTLCFLLSAFPLMATHWNTRLTKMAIGIF

SEQ ID NO: 33115 - protein, 61 aa, Homo sapiens
MGELQQEAAEKDEEPSANSRMEGPQGPPRRPGVTLCFLLSAFPLMATHWNTRLTKMAIGIF

SEQ ID NO: 33116 - protein, 37 aa, Homo sapiens
LSLIRTPLTPRSWNLTAGQENLFLETSTEPACMNGFC

SEQ ID NO: 33117 - protein, 20 aa, Homo sapiens
RSQAQTAGWRDHRDHQEGPE

SEQ ID NO: 33118 - protein, 9 aa, Homo sapiens
QRWLSVYSS

SEQ ID NO: 33119 - protein, 962 aa, Homo sapiens
MCLSALANLTWQSRTQDEHPKTMFSKDKDIIPFIDKYWECMTTRQRPGKMTWPNNIVKTMSKERDVFLVKEHPDPGSKDPEEDYPKFGLLDQEGAGDTSEVMDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQEGAGDTSEVMDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQEGAGDTSEVMDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQEGAGDTSEVMDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQEGAGDTSEVMDTQAGSVDEENGRQLGEVELQCGICTKWFTADTFGIDTSSCLPFMTNYSFHCNVCHHSGNTYFLRKQANLKEMCLSALANLTWQSRTQDEHPKTMFSKDKDIIPFIDKYWECMTTRQRPGKMTWPNNIVKTMSKERDVFLVKEHPDPGSKDPEEDYPKFGLLDQ

SEQ ID NO: 33120 - protein, 15 aa, Homo sapiens
RRAPWMKRMADSWVR

SEQ ID NO: 33121 - protein, 46 aa, Homo sapiens
RNTQIQAVKIQKKITPNLDFWIRTLVTLVLLMTTKNRAVLCLLVGI

SEQ ID NO: 33122 - protein, 96 aa, Homo sapiens
MDIIPFIDKYWECMTTRQRPGKMTWPNNIVKTMSKERDVFLVKEHPDPGSKDPEEDYPKFGLLDQDLSNIGPAYDNQKQSSAVSTSGNLNGYYTIY

SEQ ID NO: 33123 - protein, 37 aa, Homo sapiens
MILSTFHDQLQFSLQRLPSQWEYLFPPEASKLEGNVP

SEQ ID NO: 33124 - protein, 8 aa, Homo sapiens
VTWAGAPW

SEQ ID NO: 33125 - protein, 37 aa, Homo sapiens
MGTLTRGNCSRKQRKRTRSQAQTAGWRDHRDHQEGPE

SEQ ID NO: 33126 - protein, 24 aa, Homo sapiens
MHLKMELKSLLISRKTLMKNVYMK

SEQ ID NO: 33127 - protein, 32 aa, Homo sapiens
KHLGSQHQMHLKMELKSLLISRKTLMKNVYMK

SEQ ID NO: 33128 - protein, 13 aa, Homo sapiens
MCNKRMMGVVCGI

SEQ ID NO: 33129 - protein, 24 aa, Homo sapiens
MKAVKIHLKNLRIVMFNVKQSVTS

SEQ ID NO: 33130 - protein, 18 aa, Homo sapiens
QKKQLFWDKARFFQRFWN

SEQ ID NO: 33131 - protein, 13 aa, Homo sapiens
RLMSAIKKPKGNS

SEQ ID NO: 33132 - protein, 37 aa, Homo sapiens
KQKILSQKERNQMSIQKIWRRPIGSQKNLAKETTLLG

SEQ ID NO: 33133 - protein, 25 aa, Homo sapiens
ILPKILELKTCFGQKSINLRLPVNL

SEQ ID NO: 33134 - protein, 18 aa, Homo sapiens
QKKQLFWDKARFFQRILL

SEQ ID NO: 33135 - protein, 329 aa, Homo sapiens
ILPKDSVIIIDSSPTALKHPEKNQKKLQCLNDVLGKKLNTSTKNVPGKMKVAPLFLVRKAQKAADPVPSFDESSQDTSEKSQDCDVQCKAKRDFLMSGLPDLLKRQIAKKAAALDVYNAVSTSFQRVVHVQQKDDGCCLWHLKPPSCPLLTKFKELNTKVIDLSKCGIALGEFSTLNSKLKSGNSAAVFMRTRKEFTEEVRNLLLEEIRWSNPEFSLKKYFPLLLKKQIEHQVLSSECHSKQELEADVSHKETKRKLVEAENSKSKRKKPNEYSKNLEKTNRKSEELSKRNNSSGIKLDSSKGFCYNNRFKSYCFKASREKSEETSVFE

SEQ ID NO: 33136 - protein, 172 aa, Homo sapiens
MLWTEKYQPQTASELIGNELAIKKLHSWLKDWKRRAELEERQNLKGKRDEKHEDFSGGIDFKGSSDDEEESRLCNTVLITGPTGVGKTAAVYACAQELGFKIFEVNASSQRSGRQILSQLKEATQSHQVDKQGVNSQKPCFFNSYYIGKSPIKIHLKNLRIVMFNVKQSVTS

SEQ ID NO: 33137 - protein, 42 aa, Homo sapiens
MLWTEKYQPQTASELIGNELAIKKLHRVLFVAFETTLLSSLN

SEQ ID NO: 33138 - protein, 24 aa, Homo sapiens
LQILVISEKVSFTYNSGLEVEVEF

SEQ ID NO: 33139 - protein, 11 aa, Homo sapiens
MWYQPLQRIAQ

SEQ ID NO: 33140 - protein, 181 aa, Homo sapiens
AQPVLAVAGGVTQLPNHVVNVVPAPSANSPVNGKLSVTKPVLQSTMRNVGSDIAVLRRQQRMIKNRESACQSRKKKKEYMLGLEARLKAALSENEQLKKENGTLKRQLDEVVSENQRLKVPSPKRRVVCVMIVLAFIILNYGPMRPDGFAVSAYCGTTSSTWSSALCSASPCCCWGSHTAP

SEQ ID NO: 33141 - protein, 299 aa, Homo sapiens
MIKNRESACQSRKKKKEYMLGLEARLKAALSENEQLKKENGTLKRQLDEVVSENQRLKVPSPKRRVVCVMIVLAFIILNYGPMSMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRILLSLLNSVISQTLMSCNWKQQMRRMKTILIILILIWI

SEQ ID NO: 33142 - protein, 356 aa, Homo sapiens
MIAVLRRQQRMIKNRESACQSRKKKKEYMLGLEARLKAALSENEQLKKENGTLKRQLDEVVSENQRLKVPSPKRRVVCVMIVLAFIILNYGPMSMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRDHLLLPATTHNKTTRPKMSIVLPAININDCCAKETATYDKKSRIRLSVSQEEERIYARVRGEIKGCPLRKRATEERKWNTEAAAG

SEQ ID NO: 33143 - protein, 241 aa, Homo sapiens
MNQRLKVPSPKRRVVCVMIVLAFIILNYGPMSMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRDHLLLPATTHNKTTRPKMSIVLPAININEPEA

SEQ ID NO: 33144 - protein, 12 aa, Homo sapiens
MHVGTGFQENEP

SEQ ID NO: 33145 - protein, 232 aa, Homo sapiens
QDHKTKNVNCVTSNKHKCMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRDHLLLPATTHNKTTRPKMSIVLPAININACWNRIPGE

SEQ ID NO: 33146 - protein, 184 aa, Homo sapiens
MQRMKKTPDNKLLEKSDLHSVLAQKLQAEKHDVPNRHEISPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDSR

SEQ ID NO: 33147 - protein, 17 aa, Homo sapiens
RMNMMPCRSLLLPWREN

SEQ ID NO: 33148 - protein, 8 aa, Homo sapiens
KSQPDPEG

SEQ ID NO: 33149 - protein, 786 aa, Homo sapiens
LRTKLCDLERANQTLKDEYDALQITFTALEGKLRKTTEENQELVTRWMAEKAQEANRLNAENEKDSSPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDSSPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDSSPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDSSPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDSSPGHDGTWNDNQLQEMAQLRIKHQEELTELHKKRGELAQLVIDLNNQMQRKDREMQMNEAKIAECLQTISDLETECLDLRTKLCDLERANQTLKDEYDALQITFTALEGKLRKTTEENQELVTRWMAEKAQEANRLNAENEKDS

SEQ ID NO: 33150 - protein, 11 aa, Homo sapiens
MAGMSWTLWWC

SEQ ID NO: 33151 - protein, 21 aa, Homo sapiens
IYDFSHHHSELHRPRTGAASA

SEQ ID NO: 33152 - protein, 12 aa, Homo sapiens
MGTWSGSQKQKR

SEQ ID NO: 33153 - protein, 24 aa, Homo sapiens
TMPQGTLGTGCTSSPSSSSAPFLC

SEQ ID NO: 33154 - protein, 22 aa, Homo sapiens
GGNNRLNVSSMGTWSGSQKQKR

SEQ ID NO: 33155 - protein, 535 aa, Homo sapiens
MDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTS

SEQ ID NO: 33156 - protein, 18 aa, Homo sapiens
KKQRTRNLPYRKPRRWQK

SEQ ID NO: 33157 - protein, 54 aa, Homo sapiens
KSNRRIKSQPSPCGSSGPVRCESRTCWPAGRPCITKWTRTSAGRLPTRGTCGQT

SEQ ID NO: 33158 - protein, 61 aa, Homo sapiens
MALQPRTRGTRGGRTRSGGIGGGKRTRAPGSLCRAPTCQPPGQSSRTWAAKTHPWQRILTT

SEQ ID NO: 33159 - protein, 164 aa, Homo sapiens
TPGRAAWSNPGSGRARPSEARPGTPTGGTCTGRGAAGRAAAGPRARARTGSIDVIARTAGPGRRVRRTRRSGGRGTARAAGRPGAARARARAPTGASAGEGTGMALQPRTRGTRGGRTRSGGIGGGKRTRAPGSLCRAPTCQPPGQSSRTWAAKTHPWQRILTT

SEQ ID NO: 33160 - protein, 427 aa, Homo sapiens
AREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTS

SEQ ID NO: 33161 - protein, 115 aa, Homo sapiens
MPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTS

SEQ ID NO: 33162 - protein, 64 aa, Homo sapiens
GRSPRQPWPRRPAPEPSQDGKQHRPRPHAGHPCHGHQPPERRQPPDAQQPGEPIQSRPPQDPRE

SEQ ID NO: 33163 - protein, 253 aa, Homo sapiens
AAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTS

SEQ ID NO: 33164 - protein, 20 aa, Homo sapiens
AKKRGREEGGGGRRPWGRRP

SEQ ID NO: 33165 - protein, 77 aa, Homo sapiens
MSSIALAAEDPVQPNAPRNNVLRYFDYVFTGVFTFEMVIKMIDLGLVLHQGAYFRDLWNILDFIVVSGALVAFAFTS

SEQ ID NO: 33166 - protein, 662 aa, Homo sapiens
MYDGIKSQGGVQGGMVFSIYFIVLTLFGNYTLLNVFLAIAVDNLANAQELTKVEADEQEEEEAANQKLALQKAKEVAEVSPLSAANMSIAVKEQQKNQKPAKSVWEQRTSEMRKQNLLASREALYNEMDPDERWKAAYTRHLRPDMKTHLDRPLVVDPQENRNNNTNKSRAAEPTVDQRLGQQRAEDFLRKQARYHDRARDPSGSAGLDARRPWAGSQEAELSREGPYGRESDHHAREGSLEQPGFWEGEAERGKAGDPHRRHVHRQGGSRESRSGSPRTGADGEHRRHRAHRRPGEEGPEDKAERRARHREGSRPARGGEGEGEGPDGGERRRRHRHGAPATYEGDARREDKERRHRRRKENQGSGVPVSGPNLSTTRPIQQDLGRQDPPLAEDIDNMKNNKLATAESAAPHGSLGHAGLPQSPAKMGNSTDPGPMLAIPAMATNPQNAASRRTPNNPGNPSNPGPPKTPENSLIVTNPSGTQTNSAKTARKPDHTTVDIPPACPPPLNHTVVQVNKNANPDPLPKKEEEKKEEEEDDRGEDGPKPMPPYSSMFILSTTNPLRRLCHYILNLRYFEMCILMVIAMSSIALAAEDPVQPNAPRNNVLRYFDYVFTGVFTFEMVIKMIDLGLVLHQGAYFRDLWNILDFIVVSGALVAFAFTS

SEQ ID NO: 33167 - protein, 36 aa, Homo sapiens
AASPWPPRTLCSPTHLGTTCCDTLTTFLQASLPLRW

SEQ ID NO: 33168 - protein, 22 aa, Homo sapiens
LTWGSSCIRVPTSVTSGIFSTS

SEQ ID NO: 33169 - protein, 79 aa, Homo sapiens
IAMSSIALAAEDPVQPNAPRNNVLRYFDYVFTGVFTFEMVIKMIDLGLVLHQGAYFRDLWNILDFIVVSGALVAFAFTS

SEQ ID NO: 33170 - protein, 86 aa, Homo sapiens
MPQNKQSFQYRMWQFVVSPPFEYTIMAMIALNTIVLMMKFYGASVAYENALRVFNIVFTSLFSLECVLKVMAFGILGPQAFGGRHL

SEQ ID NO: 33171 - protein, 51 aa, Homo sapiens
MCAESHGFWDSVAIAKEKTSTRLNPSESSGCYDLLKPSSGCQSSRLCLTVW

SEQ ID NO: 33172 - protein, 51 aa, Homo sapiens
ADPTHAAEQAELPVPHVAVRGVSAFRVHDHGHDRPQHHRAYDEVLWGFCCL

SEQ ID NO: 33173 - protein, 15 aa, Homo sapiens
MCAESHGFWDSEGLH

SEQ ID NO: 33174 - protein, 540 aa, Homo sapiens
LTRHMPQNKQSFQYRMWQFVVSPPFEYTIMAMIALNTIVLMMKFYGASVAYENALRVFNIVFTSLFSLECVLKVMAFGILRACIDFAISAKPLTRHMPQNKQSFQYRMWQFVVSPPFEYTIMAMIALNTIVLMMKFYGASVAYENALRVFNIVFTSLFSLECVLKVMAFGILRACIDFAISAKPLTRHMPQNKQSFQYRMWQFVVSPPFEYTIMAMIALNTIVLMMKFYGASVAYENALRVFNIVFTSLFSLECVLKVMAFGILRACIDFAISAKPLTRHMPQNKQSFQYRMWQFVVSPPFEYTIMAMIALNTIVLMMKFYGASVAYENALRVFNIVFTSLFSLECVLKVMAFGILRACIDFAISAKPLTRHMPQNKQSFQYRMWQFVVSPPFEYTIMAMIALNTIVLMMKFYGASVAYENALRVFNIVFTSLFSLECVLKVMAFGILRACIDFAISAKPLTRHMPQNKQSFQYRMWQFVVSPPFEYTIMAMIALNTIVLMMKFYGASVAYENALRVFNIVFTSLFSLECVLKVMAFGIL

SEQ ID NO: 33175 - protein, 56 aa, Homo sapiens
MCAESHGFWDSGSSSIRWTPPLRTRAPAPGTAWRCPFSTSSTLWCSPSSLSISLWP

SEQ ID NO: 33176 - protein, 565 aa, Homo sapiens
MREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALLPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTQWYRAPELLLGAKEYSTAVDMWSVGCIFGELLTQKPLFPGNSEIDQINKVFKELGTPSEKIWPGYSELPVVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 33177 - protein, 439 aa, Homo sapiens
MSEDEERENENHLLVVPESRFDRDSGESEEAEEEVGEGTPQSSALTEGDYVPDSPALLPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTQWYRAPELLLGAKEYSTAVDMWSVGCIFGELLTQKPLFPGNSEIDQINKVFKELGTPSEKIWPGYSELPVVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 33178 - protein, 574 aa, Homo sapiens
REVSAHHRTMREDYSDKVKASHWSRSPPRPPRERFELGDGRKPVKEEKMEERDLLSDLQDISDSERKTSSAESSSAESGSGSEEEEEEEEEEEEEGSTSEESEEEEEEEEEEEEETGSNSEEASEQSAEEVSEEEMSEDEERENENHLLVVPESRFDRDSGESEEAEEEVGEGTPQSSALTEGDYVPDSPALLPIELKQELPKYLPALQGCRSVEEFQCLNRIEEGTYGVVYRAKDKKTDEIVALKRLKMEKEKEGFPITSLREINTILKAQHPNIVTVREIVVGSNMDKIYIVMNYVEHDLKSLMETMKQPFLPGEVKTLMIQLLRGVKHLHDNWILHRDLKTSNLLLSHAGILKVGDFGLAREYGSPLKAYTPVVVTQWYRAPELLLGAKEYSTAVDMWSVGCIFGELLTQKPLFPGNSEIDQINKVFKELGTPSEKIWPGYSELPVVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 33179 - protein, 25 aa, Homo sapiens
KPATGVAARLGRRGSGSSWETAGSQ

SEQ ID NO: 33180 - protein, 86 aa, Homo sapiens
KKRKWKKGTCCPTYRTSATARGRPARPSPRQRNQAQVLRKKRRRRKRRRRKGAPVKNQRRRRRKRKRRRRRPAATLRRHQSSLPKK

SEQ ID NO: 33181 - protein, 122 aa, Homo sapiens [sequence omitted]

SEQ ID NO: 33182 - protein, 226 aa, Homo sapiens
LSHAGILKVGDFGLAREYGSPLKAYTPVVVTQWYRAPELLLGAKEYSTAVDMWSVGCIFGELLTQKPLFPGNSEIDQINKVFKELGTPSEKIWPGYSELPVVKKMTFSEHPYNNLRKRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 33183 - protein, 20 aa, Homo sapiens
ATPASSRWVILGWRGSTDPL

SEQ ID NO: 33184 - protein, 96 aa, Homo sapiens
MNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 33185 - protein, 47 aa, Homo sapiens
APSSQKDDLQRAPLQQPPQALRGSALRPGLRPHEQVPDLLPREEDQR

SEQ ID NO: 33186 - protein, 18 aa, Homo sapiens
MGRTQPGPQAWLLRLELR

SEQ ID NO: 33187 - protein, 110 aa, Homo sapiens
KRFGALLSDQGFDLMNKFLTYFPGRRISAEDGLKHEYFRETPLPIDPSMFPTWPAKSEQQRVKRGTSPRPPEGGLGYSQLGDDDLKETGFHLTTTNQGASAAGPGFSLKF

SEQ ID NO: 33188 - protein, 11 aa, Homo sapiens
QHFIAPCSRGG

SEQ ID NO: 33189 - protein, 67 aa, Homo sapiens
MAENQAASWRKLKNSQEAQQRQATLVRKLQAKVLQYRSWCQELEKRLEATGVHRWLLVFSKGAVFPV

SEQ ID NO: 33190 - protein, 11 aa, Homo sapiens
AVCLKPNNKIL

SEQ ID NO: 33191 - protein, 19 aa, Homo sapiens
RSPRGSWRSRFKLSLKPRK

SEQ ID NO: 33192 - protein, 18 aa, Homo sapiens
TESGRAGAGCCSQTAGPG

SEQ ID NO: 33193 - protein, 6902 aa, Homo sapiens
MELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQ

SEQ ID NO: 33194 - protein, 37 aa, Homo sapiens
LILRLRRARSTQSCRICRDSSPRIRKRNPSGKESRTP

SEQ ID NO: 33195 - protein, 35 aa, Homo sapiens
GSSICPPQASSRPVEDSTDPGCSEGSGPETGRASN

SEQ ID NO: 33196 - protein, 6724 aa, Homo sapiens
MAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQ

SEQ ID NO: 33197 - protein, 14 aa, Homo sapiens
RWPKGRLCKRIWPS

SEQ ID NO: 33198 - protein, 34 aa, Homo sapiens
LKEKRRWRLCGDKSRNWRSNGKCRRLLWNCCLWT

SEQ ID NO: 33199 - protein, 53 aa, Homo sapiens
KRRGGGDSAGTNPGTGEATGNAEGCFGIAVSGPEEEEPRGRSAARTDSGAREV

SEQ ID NO: 33200 - protein, 6681 aa, Homo sapiens
MIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQ

SEQ ID NO: 33201 - protein, 9 aa, Homo sapiens
ICSKNRFRS

SEQ ID NO: 33202 - protein, 25 aa, Homo sapiens
LCRGSRSESSRRIGRLRGTSWSISF

SEQ ID NO: 33203 - protein, 6750 aa, Homo sapiens
RNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQ

SEQ ID NO: 33204 - protein, 6512 aa, Homo sapiens
MQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQ

SEQ ID NO: 33205 - protein, 76 aa, Homo sapiens
AAEAERASDSGSREERPGADAAEGEDSGSRGSEDPADQDPGGGPGTDQAVLERARPGADHSEAADAGTGRGREGPK

SEQ ID NO: 33206 - protein, 6576 aa, Homo sapiens
LQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQ

SEQ ID NO: 33207 - protein, 6366 aa, Homo sapiens
MTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQVEDLKSQLVAQDDSQRLVEQEVQEKLRETQEYNRIQKELEREKASLTLSLMEKEQRLLVLQEADSIRQQELSALRQDMQEAQGEQKELSAQMELLRQEVKEKEADFLAQEAQLLEELEASHITEQQLRASLWAQEAKAAQLQLRLRSTESQLEALAAEQQPGNQAQAQAQLASLYSALQQALGSVCESRPELSGGGDSAPSVWGLEPDQNGARSLFKRGPLLTALSAEAVASALHKLHQDLWKTQQTRDVLRDQVQKLEERLTDTEAEKSQVHTELQDLQRQLSQNQEEKSKWEGKQNSLESELMELHETMASLQSRLRRAELQRMEAQGERELLQAAKENLTAQVEHLQAAVVEARAQASAAGILEEDLRTARSALKLKNEEVESERERAQALQEQGELKVAQGKALQENLALLTQTLAEREEEVETLRGQIQELEKQREMQKAALELLSLDLKKRNQEVDLQQEQIQELEKCRSVLEHLPMAVQEREQKLTVQREQIRELEKDRETQRNVLEHQLLELEKKDQMIESQRGQVQDLKKQLVTLECLALELEENHHKMECQQKLIKELEGQRETQRVALTHLTLDLEERSQELQAQSSQIHDLESHSTVLARELQERDQEVKSQREQIEELQRQKEHLTQDLERRDQELMLQKERIQVLEDQRTRQTKILEEDLEQIKLSLRERGRELTTQRQLMQERAEEGKGPSKAQRGSLEHMKLILRDKEKEVECQQEHIHELQELKDQLEQQLQGLHRKVGETSLLLSQREQEIVVLQQQLQEAREQGELKEQSLQSQLDEAQRALAQRDQELEALQQEQQQAQGQEERVKEKADALQGALEQAHMTLKERHGELQDHKEQARRLEEELAVEGRRVQALEEVLGDLRAESREQEKALLALQQQCAEQAQEHEVETRALQDSWLQAQAVLKERDQELEALRAESQSSRHQEEAARARAEALQEALGKAHAALQGKEQHLLEQAELSRSLEASTATLQASLDACQAHSRQLEEALRIQEGEIQDQDLRYQEDVQQLQQALAQRDEELRHQQEREQLLEKSLAQRVQENMIQEKQNLGQEREEEEIRGLHQSVRELQLTLAQKEQEILELRETQQRNNLEALPHSHKTSPMEEQSLKLDSLEPRLQRELERLQAALRQTEAREIEWREKAQDLALSLAQTKASVSSLQEVAMFLQASVLERDSEQQRLQ

SEQ ID NO: 33208 - protein, 13 aa, Homo sapiens
VRPASSCPSESRK

SEQ ID NO: 33209 - protein, 15 aa, Homo sapiens
RSSHFRVNWMRPREP

SEQ ID NO: 33210 - protein, 10 aa, Homo sapiens
AAPGPAQEGR

SEQ ID NO: 33211 - protein, 87 aa, Homo sapiens
GPESPSPEGPGTGGSAARTAAGPGTGGEGEGKGRRPPGSSGASPYDTEGASWRASGPQGTGTKAGGRAGSGGTAGPGPGGGAGRPKG

SEQ ID NO: 33212 - protein, 73 aa, Homo sapiens
MRWRPGPCRTAGCRPRQCSRNGTRSWKLCGQKVSPPGIRRRLPGPGLRLCRRPLARLMLPCRGKSSISSSRQN

SEQ ID NO: 33213 - protein, 15 aa, Homo sapiens
RKRQTPSRELWSKPI

SEQ ID NO: 33214 - protein, 37 aa, Homo sapiens
RSVMESFRTTRNRHEGWRKSWQWRDGGSRPWRRCWET

SEQ ID NO: 33215 - protein, 16 aa, Homo sapiens
MLPCRGKSSISSSRQN

SEQ ID NO: 33216 - protein, 19 aa, Homo sapiens
KSWQWRDGGSRPWRRCWET

SEQ ID NO: 33217 - protein, 459 aa, Homo sapiens
MSSCGVPWSRMNWSSPDGLWRRSGYTAQVQPAQQNWGPEGSRVCSWERSQEWRLSLVLMEWRSSHGDKGLNTCSKQWPGWRLTGAGCSATMSSCGVPWSRMNWSSPDGLWRRSGYTAQVQPAQQNWGPEGSRVCSWERSQEWRLSLVLMEWRSSHGDKGLNTCSKQWPGWRLTGAGCSATMSSCGVPWSRMNWSSPDGLWRRSGYTAQVQPAQQNWGPEGSRVCSWERSQEWRLSLVLMEWRSSHGDKGLNTCSKQWPGWRLTGAGCSATMSSCGVPWSRMNWSSPDGLWRRSGYTAQVQPAQQNWGPEGSRVCSWERSQEWRLSLVLMEWRSSHGDKGLNTCSKQWPGWRLTGAGCSATMSSCGVPWSRMNWSSPDGLWRRSGYTAQVQPAQQNWGPEGSRVCSWERSQEWRLSLVLMEWRSSHGDKGLNTCSKQWPGWRLTGAGCSATMSSCGVPWS

SEQ ID NO: 33218 - protein, 531 aa, Homo sapiens
LEKERLHSPGATSTAELGSRGEQGVQLGEVSGVEAEPSPDGMEKQSWRQRLEHLQQAVARLEIDRSRLQRHNVQLRSTLEQDELELTRRALEKERLHSPGATSTAELGSRGEQGVQLGEVSGVEAEPSPDGMEKQSWRQRLEHLQQAVARLEIDRSRLQRHNVQLRSTLEQDELELTRRALEKERLHSPGATSTAELGSRGEQGVQLGEVSGVEAEPSPDGMEKQSWRQRLEHLQQAVARLEIDRSRLQRHNVQLRSTLEQDELELTRRALEKERLHSPGATSTAELGSRGEQGVQLGEVSGVEAEPSPDGMEKQSWRQRLEHLQQAVARLEIDRSRLQRHNVQLRSTLEQDELELTRRALEKERLHSPGATSTAELGSRGEQGVQLGEVSGVEAEPSPDGMEKQSWRQRLEHLQQAVARLEIDRSRLQRHNVQLRSTLEQDELELTRRALEKERLHSPGATSTAELGSRGEQGVQLGEVSGVEAEPSPDGMEKQSWRQRLEHLQQAVARLEIDRSRLQRHNVQLRSTLEQ

SEQ ID NO: 33219 - protein, 49 aa, Homo sapiens
MGHGPSAHLQVCQRKSLALLGTQEPQVGGCSQEEEVNLQPWGGPQLTWE

SEQ ID NO: 33220 - protein, 12 aa, Homo sapiens
GHCPGGRDPQAG

SEQ ID NO: 33221 - protein, 11 aa, Homo sapiens
MESPRGVPCPG

SEQ ID NO: 33222 - protein, 171 aa, Homo sapiens
GKLHLLAPYGITQRGALPWLRDMYCLSSRIYFPSTSPPPSSSPSTINPEIFAFIFCCCLHLCSWVAAPHQGSLSGKNLPKIPVEVVLLQAQLTLERKQKQDYITRSAQTSRELAGLHHSLSHSLLAVAQAPEATVLEAETRRLDESLTQSLTSPGPVLLHPSPSTTQAASR

SEQ ID NO: 33223 - protein, 15 aa, Homo sapiens
APRSPRSAGVPRKRK

SEQ ID NO: 33224 - protein, 33 aa, Homo sapiens
ICNPGEDPNSPGNEANCICLLPMESPRGVPCPG

SEQ ID NO: 33225 - protein, 40 aa, Homo sapiens [sequence omitted]

SEQ ID NO: 33226 - protein, 52 aa, Homo sapiens
REVIQEVDMAASRTAALNLLRVSRNLRANQQVPNPSQSSQKPKRSQPLRRNG

SEQ ID NO: 33227 - protein, 11 aa, Homo sapiens
IYIGSNRFSSS

SEQ ID NO: 33228 - protein, 9 aa, Homo sapiens
MDGTPLFRV

SEQ ID NO: 33229 - protein, 54 aa, Homo sapiens
MQGPEAETTICSFKETTCIFRRGESGTSRLSARRSKLASSFLVQRKMETGTLRR

SEQ ID NO: 33230 - protein, 66 aa, Homo sapiens
MQEQCPNLVLKSSRRLSVEREKSKILLMRMMMMTKLPKGRLVEERLKTLVTKKMMTLRLTQMISLK

SEQ ID NO: 33231 - protein, 78 aa, Homo sapiens
MQAVKTSKSTLGQTDFPAHSRKPAPSNEPEYLCKWMGLPYSECSWEDEALIGKKFQNCIDSFHSRNNSKTIPTRECKL

SEQ ID NO: 33232 - protein, 242 aa, Homo sapiens
MQATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKPLEHLLLYMRLKLMATLVVTLTLKRMKVKSSTSSSGRVGLTSTAHGRVKNPYSNRK

SEQ ID NO: 33233 - protein, 9 aa, Homo sapiens
MATRVFIRC

SEQ ID NO: 33234 - protein, 9 aa, Homo sapiens
LISSPTIGS

SEQ ID NO: 33235 - protein, 27 aa, Homo sapiens
APDYGDPSSEFPQRALVLAALYYAGEV

SEQ ID NO: 33236 - protein, 6101 aa, Homo sapiens
LKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIR

SEQ ID NO: 33237 - protein, 5967 aa, Homo sapiens
MELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIR

SEQ ID NO: 33238 - protein, 6043 aa, Homo sapiens
KGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRSHSASEEASGSDSGSQSESEQGSDPGSGHGSESNSSSESSESQSESESESAGSKSQPVLPEAKEKPASKKERIADVKKMWEEYPDVYGVRRSNRSRQEPSRFNIKEEASSGSESGSPKRRGQRQLKKQEKWKQEPSEDEQEQGTSAESEPEQKKVKARRPVPRRTVPKPRVKKQPKTQRGKRKKQDSSDEDDDDDEAPKRQTRRRAAKNVSYKEDDDFETDSDDLIEMTGEGVDEQQDNSETIEKVLDSRLGKKGATGASTTVYAIEANGDPSGDFDTEKDEGEIQYLIKWKGWSYIHSTWESEESLQQQKVKGLKKLENFKKKEDEIKQWLGKVSPEDVEYFNCQQELASELNKQYQIVERVIAVKTSKSTLGQTDFPAHSRKPAPSNEPEYLCKWMGLPYSECSWEDEALIGKKFQNCIDSFHSRNNSKTIPTRECKALKQRPRFVALKKQPAYLGGENLELRDYQLEGLNWLAHSWCKNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIR

SEQ ID NO: 33239 - protein, 71 aa, Homo sapiens
VTLTLSLRGRPRDPLLLRVKRKTLMMTRSQSAEGVRGVCGRTSWRDLLMQRSEGSSRLIRSLVSLLNGWSA

SEQ ID NO: 33240 - protein, 21 aa, Homo sapiens
QEAKAQRASEECAEGPRGGIY

SEQ ID NO: 33241 - protein, 13 aa, Homo sapiens
IRSLVSLLNGWSA

SEQ ID NO: 33242 - protein, 26 aa, Homo sapiens
KKMPAREKDQGKGEVQQSRYPEFRLM

SEQ ID NO: 33243 - protein, 5537 aa, Homo sapiens
KKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNNSVILADEMGLGKTIQTISFLSYLFHQHQLYGPFLIVVPLSTLTSWQREFEIWAPEINVVVYIGDLMSRNTIREYEWIHSQTKRLKFNALITTYEILLKDKTVLGSINWAFLGVDEAHRLKNDDSLLYKTLIDFKSNHRLLITGTPLQNSLKELWSLLHFIMPEKFEFWEDFEEDHGKGRENGYQSLHKVLEPFLLRRVKKDVEKSLPAKVEQILRVEMSALQKQYYKWILTRNYKALAKGTRGSTSGFLNIVMELKKCCNHCYLIKPPEENERENGQEILLSLIRSSGKLILLDKLLTRLRERGNRVLIFSQMVRMLDILAEYLTIKHYPFQRLDGSIKGEIRKQALDHFNADGSEDFCFLLSTRAGGLGINLASADTVVIFDSDWNPQNDLQAQARAHRIGQKKQVNIYRLVTKGTVEEEIIERAKKKMVLDHLVIQRMDTTGRTILENNSGRSNSNPFNKEELTAILKFGAEDLFKELEGEESEPQEMDIDEILRLAETRENEVSTSATDELLSQFKVANFATMEDEEELEERPHKDWDEIIPEEQRKKVEEEERQKELEEIYMLPRIRSSTKKAQTNDSDSDTESKRQAQRSSASESETEDSDDDKKPKRRGRPRSVRKDLVEGFTDAEIRRFIKAYKKFGLPLERLECIARDAELVDKSVADLKRLGELIHNSCVSAMQEYEEQLKENASEGKGPGKRRGPTIKISGVQVNVKSIIQHEEEFEMLHKSIPVDPEEKKKYCLTCRVKAAHFDVEWGVEDDSRLLLGIYEHGYGNWELIKTDPELKLTDKILPVETDKKPQGKQLQTRADYLLKLLRKGLEKKGAVTGGEEAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWR

SEQ ID NO: 33244 - protein, 25 aa, Homo sapiens
LTKFCRWRQIKSLRGSSYRPERITC

SEQ ID NO: 33245 - protein, 8 aa, Homo sapiens
QNSAGGDR

SEQ ID NO: 33246 - protein, 19 aa, Homo sapiens
MELSFHLLGIQIIHQKREK

SEQ ID NO: 33247 - protein, 10 aa, Homo sapiens
MDFCFQVYRI

SEQ ID NO: 33248 - protein, 14 aa, Homo sapiens
IKAISGSCPYYSRK

SEQ ID NO: 33249 - protein, 27 aa, Homo sapiens
QGAQRARTAGTHPELPAENRRPDSRVP

SEQ ID NO: 33250 - protein, 23 aa, Homo sapiens
ISYTRWLIRKGLKKKRSKRRKTT

SEQ ID NO: 33251 - protein, 18 aa, Homo sapiens
LGVRNHFVQRPQAPAGTL

SEQ ID NO: 33252 - protein, 348 aa, Homo sapiens
MAHRCMDTQEITTITPTRDTSVMQAKLKKRKPRVKKENKVPRLKEEHGIELSSPRHSDNPSEEGEVKDDGLEKSPMKKKQKKKENKENKEKQMSSRKDKEGDKERKKSKDKKEKPKSGDAKSSSKSKRSQGPVHITAGSEPVPIGEDEDDDLDQETFSICKERMRPVKKALKQLDKPDKGLNVQEQLEHTRNCLLKIGDRIAECLKAYSDQEHIKLWRRNLWIFVSKFTEFDARKLHKLYKMAHKKRSQEEEEQKKKDDVTGGKKPFRPEASGSSRDSLISQSHTSHNLHPQKPHLPASHGPQMHGHPRDNYNHPNKRHFSNAGQIKEAEASGKEGKQSAQAERGAWN

SEQ ID NO: 33253 - protein, 173 aa, Homo sapiens
KLYKMAHKKRSQEEEEQKKKDDVTGGKKPFRPEASGSSRDSLISQSHTSHNLHPQKPHLPASHGPQMHGHPRDNYNHPNKRHFSNADRGDWQRERKFNYGGGNNNPPWGSDRHHQYEQHWYKDHHYGDRRHMDAHRSGSYRPNNMSRKRPYDQYSSDRDHRGHRDYYDSVRRG

SEQ ID NO: 33254 - protein, 982 aa, Homo sapiens
MSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNE

SEQ ID NO: 33255 - protein, 928 aa, Homo sapiens
MLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNE

SEQ ID NO: 33256 - protein, 989 aa, Homo sapiens
AGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNE

SEQ ID NO: 33257 - protein, 19 aa, Homo sapiens
LVPKPTRCPWPTEGRISLF

SEQ ID NO: 33258 - protein, 30 aa, Homo sapiens
ISQTNRLSLLLRIMAMPWTTPSLLAGNHFL

SEQ ID NO: 33259 - protein, 31 aa, Homo sapiens
MSTIKQMRVPCLGRLNLKVSLWILWIQINRI

SEQ ID NO: 33260 - protein, 16 aa, Homo sapiens
MSVTNCTLKSCPWRES

SEQ ID NO: 33261 - protein, 21 aa, Homo sapiens
QTISMLPTMVRSMMSILMTME

SEQ ID NO: 33262 - protein, 33 aa, Homo sapiens
AVVHITLAAVWNLIGVLSLVSAHCVNLARRRWW

SEQ ID NO: 33263 - protein, 2609 aa, Homo sapiens
LEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGE

SEQ ID NO: 33264 - protein, 8 aa, Homo sapiens
MWYSLRMR

SEQ ID NO: 33265 - protein, 13 aa, Homo sapiens
KRRLEFLRSTQWC

SEQ ID NO: 33266 - protein, 9 aa, Homo sapiens
QNLLKGPEK

SEQ ID NO: 33267 - protein, 22 aa, Homo sapiens
RGPRSRNGRCWQRWKGYLSCHL

SEQ ID NO: 33268 - protein, 38 aa, Homo sapiens
MWWLHHISWRPDSKQPGSSSIQEWCQDHGHKPPADRQG

SEQ ID NO: 33269 - protein, 20 aa, Homo sapiens
AQTLMSVTNCTLKSCPWRES

SEQ ID NO: 33270 - protein, 14 aa, Homo sapiens
ARLWSISHWQQCGI

SEQ ID NO: 33271 - protein, 28 aa, Homo sapiens
MLPGRLQRLLPSLVHSTSNFLSKEMMSW

SEQ ID NO: 33272 - protein, 10 aa, Homo sapiens
AHTNHQPRGH

SEQ ID NO: 33273 - protein, 8 aa, Homo sapiens
IFLYSSNK

SEQ ID NO: 33274 - protein, 15 aa, Homo sapiens
GFSQMGGRPDRLSMD

SEQ ID NO: 33275 - protein, 25 aa, Homo sapiens
MYCSNNFMVPVLKDLWNWYLHTSYQ

SEQ ID NO: 33276 - protein, 8 aa, Homo sapiens
LQLEKAAH

SEQ ID NO: 33277 - protein, 56 aa, Homo sapiens
IDCSWKRQLTEAAPCFWNGASHPIQPFTRPEMYCSNNFMVPVLKDLWNWYLHTSYQ

SEQ ID NO: 33278 - protein, 18 aa, Homo sapiens
KKPGFVRCGLVDSQCTAA

SEQ ID NO: 33279 - protein, 37 aa, Homo sapiens
ASHPIQPFTRPEMYCSNNFMVPVLKDLWNWYLHTSYQ

SEQ ID NO: 33280 - protein, 10 aa, Homo sapiens
VPPCERNPDL

SEQ ID NO: 33281 - protein, 14 aa, Homo sapiens
MKQIECLIWALNPK

SEQ ID NO: 33282 - protein, 11 aa, Homo sapiens
LPLSTSIISHS

SEQ ID NO: 33283 - protein, 9 aa, Homo sapiens
LLNIVEHVA

SEQ ID NO: 33284 - protein, 32 aa, Homo sapiens
MKPISLQMSWMLLQDRISLNPLLFKLRDGQLL

SEQ ID NO: 33285 - protein, 1446 aa, Homo sapiens
MWSATWPKEVRQLAEDFLKDYIHINIGALELSANHNILQIVDVCHDVEKDEKLIRLMEEIMSEKENKTIVFVETYRRSKEITVRGHNCPKPVLNFYEANFPANVMDVIARQNFTEPTAIQAQGWPVALSGLDMVGVAQTGSGKTLSYLLPAIVHINHQPFLERGDGPICLVLAPTRELAQQVQQVAAEYCRACRLKSTCIYGGAPKGPQIRDLERGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVFVETYRRSKEITVRGHNCPKPVLNFYEANFPANVMDVIARQNFTEPTAIQAQGWPVALSGLDMVGVAQTGSGKTLSYLLPAIVHINHQPFLERGDGPICLVLAPTRELAQQVQQVAAEYCRACRLKSTCIYGGAPKGPQIRDLERGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVFVETYRRSKEITVRGHNCPKPVLNFYEANFPANVMDVIARQNFTEPTAIQAQGWPVALSGLDMVGVAQTGSGKTLSYLLPAIVHINHQPFLERGDGPICLVLAPTRELAQQVQQVAAEYCRACRLKSTCIYGGAPKGPQIRDLERGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVFVETYRRSKEITVRGHNCPKPVLNFYEANFPANVMDVIARQNFTEPTAIQAQGWPVALSGLDMVGVAQTGSGKTLSYLLPAIVHINHQPFLERGDGPICLVLAPTRELAQQVQQVAAEYCRACRLKSTCIYGGAPKGPQIRDLERGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVFVETYRRSKEITVRGHNCPKPVLNFYEANFPANVMDVIARQNFTEPTAIQAQGWPVALSGLDMVGVAQTGSGKTLSYLLPAIVHINHQPFLERGDGPICLVLAPTRELAQQVQQVAAEYCRACRLKSTCIYGGAPKGPQIRDLERGVEICIATPGRLIDFLECGKTNLRRTTYLVLDEADRMLDMGFEPQIRKIVDQIRPDRQTLMWSATWPKEVRQLAEDFLKDYIHINIGALELSANHNILQIVDVCHDVEKDEKLIRLMEEIMSEKENKTIVF

SEQ ID NO: 33286 - protein, 17 aa, Homo sapiens
ANSNVECDLAKRSKTAC

SEQ ID NO: 33287 - protein, 15 aa, Homo sapiens
VQTTTFFRLWMCVMT

SEQ ID NO: 33288 - protein, 19 aa, Homo sapiens
TSQVLNGSVLCPNVLLDVK

SEQ ID NO: 33289 - protein, 17 aa, Homo sapiens
QWTKDDQSNSSRCSKTY

SEQ ID NO: 33290 - protein, 60 aa, Homo sapiens
QWTKDDQSNSSRCSKTSSWGKPQGKTLRNGFLHEALDEMTTPQQTTPQTKKNDMMQSSGK

SEQ ID NO: 33291 - protein, 1331 aa, Homo sapiens
IRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADELLEKKKRVQLKDMGEDLECLCQIMRTVGPRLDHERAKSLMDQYFARMCSLMLSKELPARIRFLLQDTVELREHHWVPRKAFLDNGPKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADELLEKKKRVQLKDMGEDLECLCQIMRTVGPRLDHERAKSLMDQYFARMCSLMLSKELPARIRFLLQDTVELREHHWVPRKAFLDNGPKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADELLEKKKRVQLKDMGEDLECLCQIMRTVGPRLDHERAKSLMDQYFARMCSLMLSKELPARIRFLLQDTVELREHHWVPRKAFLDNGPKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADELLEKKKRVQLKDMGEDLECLCQIMRTVGPRLDHERAKSLMDQYFARMCSLMLSKELPARIRFLLQDTVELREHHWVPRKAFLDNGPKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADELLEKKKRVQLKDMGEDLECLCQIMRTVGPRLDHERAKSLMDQYFARMCSLMLSKELPARIRFLLQDTVELREHHWVPRKAFLDNGPKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADE

SEQ ID NO: 33292 - protein, 11 aa, Homo sapiens
IVEMQMRLSMV

SEQ ID NO: 33293 - protein, 12 aa, Homo sapiens
IEAMKIKKKQVL

SEQ ID NO: 33294 - protein, 11 aa, Homo sapiens
GCQWCKRNEGS

SEQ ID NO: 33295 - protein, 35 aa, Homo sapiens
MLSYVCDWQKMHQTLMAQQQRVNQDRSKAPHSDAS

SEQ ID NO: 33296 - protein, 26 aa, Homo sapiens
ALDEMTTPQQTTPQTKKNDMMQSSGK

SEQ ID NO: 33297 - protein, 19 aa, Homo sapiens
ISLLLKSLTSYALSSSMWV

SEQ ID NO: 33298 - protein, 14 aa, Homo sapiens
QLRSKQLRKRKRTT

SEQ ID NO: 33299 - protein, 8 aa, Homo sapiens
APQCGCRV

SEQ ID NO: 33300 - protein, 16 aa, Homo sapiens
RGHTADCGQSPRRAKV

SEQ ID NO: 33301 - protein, 321 aa, Homo sapiens
MGEDLECLCQIMRTVGPRLDHERAKSLMDQYFARMCSLMLSKELPARIRFLLQDTVELREHHWVPRKAFLDNGPKTINQIRQDAVKDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTVFHFSCPLPSPPHLLILFF

SEQ ID NO: 33302 - protein, 33 aa, Homo sapiens
VHQNTFGKEEESPTQRYGRGFGVPLSDNEDSGT

SEQ ID NO: 33303 - protein, 49 aa, Homo sapiens
VHQNTSSWGKPQGKTLRNGFLHEALDEMTTPQQTTPQTKKNDMMQSSGK

SEQ ID NO: 33304 - protein, 27 aa, Homo sapiens
QINSSMAMGDTSCLPHNRSLERWEASL

SEQ ID NO: 33305 - protein, 26 aa, Homo sapiens
MQMSFWKRRRESNSKIWERIWSASVR

SEQ ID NO: 33306 - protein, 58 aa, Homo sapiens
ASSTITRVRDSYPSCKDSRRICHLGFLRKDSLMQMSFWKRRRESNSKIWERIWSASVR

SEQ ID NO: 33307 - protein, 35 aa, Homo sapiens
MQKMLPAFGKEEESPTQRYGRGFGVPLSDNEDSGT

SEQ ID NO: 33308 - protein, 46 aa, Homo sapiens
ITRSRMVNRTFSTKQGQYAENAPSFWKRRRESNSKIWERIWSASVR

SEQ ID NO: 33309 - protein, 2956 aa, Homo sapiens
MQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQ

SEQ ID NO: 33310 - protein, 94 aa, Homo sapiens
MQAFLNVLDQCPKLEVDIPLVKSYLAQFAARAIISELVSISELAQPLESGTHFPLFLLCLQQLAKLQDREWLTELFQQSKFFDQFTQTGRDSHK

SEQ ID NO: 33311 - protein, 17 aa, Homo sapiens
ITRSRMVNRTFSTKQVL

SEQ ID NO: 33312 - protein, 2761 aa, Homo sapiens
MAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQDLGVFIPAPMAQGMRSDFFLEGPFMPPRMKMDRDPLGGLADMFGQMPGSGIGTGPGVIQDRFSPTMGRHRSNQLFNGHGGHIMPPTQSQFGEMGGKFMKSQGLSQLYHNQSQGLLSQLQGQSKDMPPRFSKKGQLNADEISLRPAQSFLMNKNQVPKLQPQITMIPPSAQPPRTQTPPLGQTPQLGLKTNPPLIQEKPAKTSKKPPPSKEELLKLTETVVTEYLNSGNANEAVNGVREMRAPKHFLPEMLSKVIILSLDRSDEDKEKASSLISLLKQEGIATSDNFMQAFLNVLDQCPKLEVDIPLVKSYLAQFAARAIISELVSISELAQPLESGTHFPLFLLCLQQLAKLQDREWLTELFQQSKVNMQKMLPEIDQNKDRMLEILEGKGLSFLFPLLKLEKELLKQIKLDPSPQTIYKWIKDNISPKLHVDKGFVNILMTSFLQYISSEVNPPSDETDSSSAPSKEQLEQEKQLLLSFKPVMQKFLHDHVDLQVSALYALQVHCYNSNFPKGMLLRFFVHFYDMEIIEEEAFLAWKEDITQEFPGKGKALFQ

SEQ ID NO: 33313 - protein, 19 aa, Homo sapiens
MLMERLFTQVSRCISQHLS

SEQ ID NO: 33314 - protein, 111 aa, Homo sapiens
MLMFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYVFPEASNTAS

SEQ ID NO: 33315 - protein, 133 aa, Homo sapiens
MLMFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYVCSGASTSPSSVFPEASNTAS

SEQ ID NO: 33316 - protein, 197 aa, Homo sapiens
MLMTPYPSGQNAGPTTLVYPQTPQTMNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYDPLSLWTECRSNHAGIPSNPSDNEFTTSNPFSVCSGASTSPSSVFPEASNTAS

SEQ ID NO: 33317 - protein, 206 aa, Homo sapiens
MLMVTQVARQPGTPTPSPYSAHEINKGHPNLAATPPGHASSPGLSQTPYPSGQNAGPTTLVYPQTPQTMNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGNTSGKTAGNPYPIPLFST

SEQ ID NO: 33318 - protein, 180 aa, Homo sapiens
MMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQQLPSQVPEHSPVVYGTVESAHLAASTPVTAASDQKQVFPEASNTAS

SEQ ID NO: 33319 - protein, 15 aa, Homo sapiens
MQVQPRWYTLKPLRQ

SEQ ID NO: 33320 - protein, 44 aa, Homo sapiens
MTDVNSHPQEKTQFLYPASHLAQKHQTLYQQMKMMMIYARNPVV

SEQ ID NO: 33321 - protein, 11 aa, Homo sapiens
MEETKRSDPNH

SEQ ID NO: 33322 - protein, 28 aa, Homo sapiens
QDQPTQIANANSGSSNFASRTRLYTSLC

SEQ ID NO: 33323 - protein, 17 aa, Homo sapiens
MDCQFWNRAKPQLALHW

SEQ ID NO: 33324 - protein, 77 aa, Homo sapiens
MTGSFCWTSSSCLPVYKNQRACLLSVMWFLTRSTNPNCQCELWILEFCLEDQTLHQPLLILEGRHLVEEAYLILEAY

SEQ ID NO: 33325 - protein, 54 aa, Homo sapiens
MMMSLRRSRKNLRLPVLQRRGQGFMMNWKKPRTKPGGDPLATSSLLENSLNSKC

SEQ ID NO: 33326 - protein, 27 aa, Homo sapiens
KELLTWSLRRLLMNPVSLWLTQTCVDV

SEQ ID NO: 33327 - protein, 11 aa, Homo sapiens
KYPWQTSLVTQ

SEQ ID NO: 33328 - protein, 9 aa, Homo sapiens
LCGEAAKEP

SEQ ID NO: 33329 - protein, 9 aa, Homo sapiens
LKPSCMTVW

SEQ ID NO: 33330 - protein, 16 aa, Homo sapiens
KKEKPHLGFGSCFKML

SEQ ID NO: 33331 - protein, 1440 aa, Homo sapiens
MLQDVIDLRLLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRL

SEQ ID NO: 33332 - protein, 15 aa, Homo sapiens
MTSPFHLQQLGQILS

SEQ ID NO: 33333 - protein, 19 aa, Homo sapiens
QAPSICNSSAKYFHEGWQQ

SEQ ID NO: 33334 - protein, 3519 aa, Homo sapiens
MSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQM

SEQ ID NO: 33335 - protein, 3594 aa, Homo sapiens
REKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQM

SEQ ID NO: 33336 - protein, 9 aa, Homo sapiens
MPRAYYMFL

SEQ ID NO: 33337 - protein, 3419 aa, Homo sapiens
MAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQM

SEQ ID NO: 33338 - protein, 14 aa, Homo sapiens
QTFTSCWKSWGLAI

SEQ ID NO: 33339 - protein, 2944 aa, Homo sapiens
MSHKKVGALWREADLSWKDFLPEGEDVHNFLLEQLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMSHKKVGALWREADLSWKDFLPEGEDVHNFLLEQ

SEQ ID NO: 33340 - protein, 10 aa, Homo sapiens
MSWKYGQGEE

SEQ ID NO: 33341 - protein, 3361 aa, Homo sapiens
MLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQM

SEQ ID NO: 33342 - protein, 1174 aa, Homo sapiens
QYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQTPYPSGQNAGPTTLVYPQTPQTMNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQTPYPSGQNAGPTTLVYPQTPQTMNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQTPYPSGQNAGPTTLVYPQTPQTMNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQTPYPSGQNAGPTTLVYPQTPQTMNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQTPYPSGQNAGPTTLVYPQTPQTMNSQPQTRSPFAAGPRPPHHQFFQRPQIQPPRATIPNSSPSIRPGAQTPTAVYQANQHIMMVNHLPMPYPVPQGPQYCIPQYRHSGPPYVGPPQQYPVQPPGPGPFYPGPGPGDFPNAYGTPFYPSQPVYQSAPIIVPTQQQPPPAKREKKTIRIRDPNQGGKDITEEIMSGGGSRNPTPPIGRPTSTPTPPQ

SEQ ID NO: 33343 - protein, 15 aa, Homo sapiens
ASPQWREERTRRPDI

SEQ ID NO: 33344 - protein, 13 aa, Homo sapiens
MKMMMIYARNPVV

SEQ ID NO: 33345 - protein, 606 aa, Homo sapiens
IAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPAQIAITVPKTWKKPKDRTRTTEEMLEAELELKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPICKVQSRHGLPILEQSKAPTCPPLVMSHPPMKSLPLGLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTRRSQNQIQC

SEQ ID NO: 33346 - protein, 279 aa, Homo sapiens
IAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPAQIAITVPKTWKKPKDRTRTTEEMLEAELERRSQNQIQC

SEQ ID NO: 33347 - protein, 271 aa, Homo sapiens
IAELPLPPSPTTVSSVARSTIAAPTSSALSSQPIFTTAIDDRCELSSPREDTIPIPSLTSCTETSDPLPTNENDDDICKKPCSVAPNDIPLVSSTNLINEINGVSEKLSATESIVEIVKQEVLPLTLELEILENPPEEMKLECIPAPITPSTVPSFPPTPPTPPASPPHTPVIVPAAATTVSSPSAAITVQRVLEEDESIRTCLSEDAKEIQNKIEVEADGQTEEILDSQNLNSRRSPVPAAAQPGPRAQPCGLWDCGERSSCCQHPCHCS

SEQ ID NO: 33348 - protein, 1369 aa, Homo sapiens
MKSLPLGLLNVGSRRSQPGQRREPRKIITVSVKEDVHLKKAENAWKPSQKRDSQADDPENIKTQLKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPICKVQSRHGLPILEQSKAPTCPPLVMSHPPMKSLPLGLLNVGSRRSQPGQRREPRKIITVSVKEDVHLKKAENAWKPSQKRDSQADDPENIKTQLKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPICKVQSRHGLPILEQSKAPTCPPLVMSHPPMKSLPLGLLNVGSRRSQPGQRREPRKIITVSVKEDVHLKKAENAWKPSQKRDSQADDPENIKTQLKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPICKVQSRHGLPILEQSKAPTCPPLVMSHPPMKSLPLGLLNVGSRRSQPGQRREPRKIITVSVKEDVHLKKAENAWKPSQKRDSQADDPENIKTQLKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPICKVQSRHGLPILEQSKAPTCPPLVMSHPPMKSLPLGLLNVGSRRSQPGQRREPRKIITVSVKEDVHLKKAENAWKPSQKRDSQADDPENIKTQLKAEEELSIDKVLESEQDKMSQGFHPERDPSDLKKVKAVEENGEEAEPVRNGAESVSEGEGIDANSGSTDSSGDGVTFPFKPESWKPTDTEGKKQYDREFLLDFQFMPACIQKPEGLPPISDVVLDKINQPKLPMRTLDPRILPRGPDFTPAFADFGRQTPGGRGVPICKVQSRHGLPILEQSKAPTCPPLVMSHPPMKSLPLGLLNVGSRRSQPGQRREPRKIITVSVKEDVHLKKAENAWKPSQKRDSQADDPENIKTQ

SEQ ID NO: 33349 - protein, 22 aa, Homo sapiens
MLGHEDLNLAKEENPERSSQFL

SEQ ID NO: 33350 - protein, 28 aa, Homo sapiens
MIPKTLKPSLKLKRSFPLTKYLNLNKIK

SEQ ID NO: 33351 - protein, 39 aa, Homo sapiens
MMKNPWSACVACSPPLAKTWTLKKQSHVWTSTLIRWRKL

SEQ ID NO: 33352 - protein, 12 aa, Homo sapiens
GCQCSRGEDKAS

SEQ ID NO: 33353 - protein, 45 aa, Homo sapiens
KNLRLPVLQRRGQGFMMNWKKPRTKPGGDPLATSSLLENSLNSKC

SEQ ID NO: 33354 - protein, 11 aa, Homo sapiens
MKKFSWYLKHS

SEQ ID NO: 33355 - protein, 25 aa, Homo sapiens
GCAIGYLEEQIKGLKLSNRFTKRLK

SEQ ID NO: 33356 - protein, 12 aa, Homo sapiens
KNKKSKGRSSNS

SEQ ID NO: 33357 - protein, 553 aa, Homo sapiens
MDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITK

SEQ ID NO: 33358 - protein, 1191 aa, Homo sapiens
MADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITK

SEQ ID NO: 33359 - protein, 29 aa, Homo sapiens
TVKCFQFKQILCPATSSTLRVHAIHACRV

SEQ ID NO: 33360 - protein, 3576 aa, Homo sapiens
MRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQMLLNVGSRRSQPGQRREPRKIITVSVKEDVHLKKAENAWKPSQKRDSQADDPENIKTQELFRKVRSILNKLTPQMFNQLMKQVSGLTVDTEERLKGVIDLVFEKAIDEPSFSVAYANMCRCLVTLKVPMADKPGNTVNFRKLLLNRCQKEFEKDKADDDVFEKKQKELEAASAPEERTRLHDELEEAKDKARRRSIGNIKFIGELFKLKMLTEAIMHDCVVKLLKNHDEESLECLCRLLTTIGKDLDFEKAKPRMDQYFNQMEKIVKERKTSSRIRFMLQDVIDLRLCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKEAMQCVEELNAQGLLHVFVRVGVESTLERSQITRDHMGQLLYQLVQSEKLSKQDFFKGFSETLELADDMAIDIPHIWLYLAELVTPMLKEGGISMRELTIEFSKPLLPVGRAGVLLSEILHLLCKQM

SEQ ID NO: 33361 - protein, 1384 aa, Homo sapiens
MRGGSSKDLLDNQSQEEQRREMLETVKQLTGGVDVERNSTEAERNKTRESAKPEISAMSAHDKAALSEEELERKSKSIIDEFLHINDFKCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFKCNWVSRRADQGPKTIEQIHKEAKIEEQEEQRKVQQLMTKEKRRPGVQRVDEGGWNTVQGAKNSRVLDPSKFLKITKPTIDEKIQLVPKAQLGSWGKGSSGGAKASETDALRSSASSLNRFSALQPPAPSGSTPSTPVEFDSRRTLTSRGSMGREKNDKPLPSATARPNTFMRGGSSKDLLDNQSQEEQRREMLETVKQLTGGVDVERNSTEAERNKTRESAKPEISAMSAHDKAALSEEELERKSKSIIDEFLHINDFK

SEQ ID NO: 33362 - protein, 24 aa, Homo sapiens
QVPRLRYREGTASTLCTTSIDSKT

SEQ ID NO: 33363 - protein, 88 aa, Homo sapiens
KYLDSDTEKELQALYALQASIVKLDQPANLLRMFFDCLYDEEVISEDAFYKWESSKDPAEQNGKGVALKSVTAFFTWLREAEEESEDN

SEQ ID NO: 33364 - protein, 20 aa, Homo sapiens
MSSVGSLSCWRRMAWPSRRP

SEQ ID NO: 33365 - protein, 24 aa, Homo sapiens
LVEDAGSGLDQLPSGEEQVRRKRH

SEQ ID NO: 33366 - protein, 14 aa, Homo sapiens
LFPLLPPLGPMTWY

SEQ ID NO: 33367 - protein, 109 aa, Homo sapiens
ATPRCHWRVQRRPAGWGNSPSSGRRRRFWTGSATKWRRTSTTQAPLTSHDVTWMAPPSAIVPLRSCVWSLGLWGTNSMPSCETSLPALLMSSVGSLSCWRRMAWPSRRP

SEQ ID NO: 33368 - protein, 20 aa, Homo sapiens
KIPSRPSRSWLRCVSWPTAH

SEQ ID NO: 33369 - protein, 131 aa, Homo sapiens
IPDYVLGQSTCALFLSLRYHNLHPDYIHGRLQSLGKNFALRVLLVQVDVKDPQQALKELAKMCILADCTLILAWRPSPYSDLHRAFPLWTPRPRRPLRPTPNMPSHSLWKGLGPRAPQGQSPWQERRPTRP

SEQ ID NO: 33370 - protein, 8 aa, Homo sapiens
MCPGNLAT

SEQ ID NO: 33371 - protein, 38 aa, Homo sapiens
RRPLRPTPNMPSHSLWKGLGPRAPQGQSPWQERRPTRP

SEQ ID NO: 33372 - protein, 9 aa, Homo sapiens
ALGRGAIPY

SEQ ID NO: 33373 - protein, 821 aa, Homo sapiens
GGPSDLRRICHLTASGRGWGHVPHRVRAPGRRDAQPGPETRGKIQQHHCEPSAEGQSRTEVRAQCALGIWRRNSRLCAGPEHLCPVPQPPLPQPAPRLHPWAAAEPGEELRLAGPACPGGCGQALIPIYTEPSHCGHLGPGGPSDLRRICHLTASGRGWGHVPHRVRAPGRRDAQPGPETRGKIQQHHCEPSAEGQSRTEVRAQCALGIWRRNSRLCAGPEHLCPVPQPPLPQPAPRLHPWAAAEPGEELRLAGPACPGGCGQALIPIYTEPSHCGHLGPGGPSDLRRICHLTASGRGWGHVPHRVRAPGRRDAQPGPETRGKIQQHHCEPSAEGQSRTEVRAQCALGIWRRNSRLCAGPEHLCPVPQPPLPQPAPRLHPWAAAEPGEELRLAGPACPGGCGQALIPIYTEPSHCGHLGPGGPSDLRRICHLTASGRGWGHVPHRVRAPGRRDAQPGPETRGKIQQHHCEPSAEGQSRTEVRAQCALGIWRRNSRLCAGPEHLCPVPQPPLPQPAPRLHPWAAAEPGEELRLAGPACPGGCGQALIPIYTEPSHCGHLGPGGPSDLRRICHLTASGRGWGHVPHRVRAPGRRDAQPGPETRGKIQQHHCEPSAEGQSRTEVRAQCALGIWRRNSRLCAGPEHLCPVPQPPLPQPAPRLHPWAAAEPGEELRLAGPACPGGCGQALIPIYTEPSHCGHLGPGGPSDLRRICHLTASGRGWGHVPHRVRAPGRRDAQPGPETRGKIQQHHCEPSAEGQSRTEVRAQCALGIWRRNSRLCAGPEHLCPVPQPPLPQPAPRLHPWAAAEPGEELRLAGPACPGGC

SEQ ID NO: 33374 - protein, 21 aa, Homo sapiens
MKVMKLRCIPEQMKKSLAVGG

SEQ ID NO: 33375 - protein, 111 aa, Homo sapiens
MVPFVFVGTKDSIANATVLLDYHLNYLKEVDQLRLERLQIDEQLRQIGASSRPPPNRTDKEKSYVTDDGQGMGRGSRPYRNRGHGRRGPGYTSAGSLIGRFHFMMSDSHLL

SEQ ID NO: 33376 - protein, 18 aa, Homo sapiens
RKTAPIFLNLTVQKSRGC

SEQ ID NO: 33377 - protein, 31 aa, Homo sapiens
AVPSQTAAMKGVSPTRLVTPGGDHMRLVVTC

SEQ ID NO: 33378 - protein, 10 aa, Homo sapiens
QVHWEHLPSG

SEQ ID NO: 33379 - protein, 8 aa, Homo sapiens
RGSVLQDW

SEQ ID NO: 33380 - protein, 51 aa, Homo sapiens
MSRTRNTLSAQTTLFWFRLEEEIPMVPCATSPSYTTTTITLIALLRAEETT

SEQ ID NO: 33381 - protein, 63 aa, Homo sapiens
ANALHVPGQRSQLPRDSCNPDLRWQLKWRAMCLTIHLQWQDVLLLHHRRATGRTSLVQHNFEL

SEQ ID NO: 33382 - protein, 1946 aa, Homo sapiens
MMRCTCVGNGRGEWTCIAYSQLRDQCIVDDITYNVNDTFHKRHEEGHMLNCTCFGQGRGRWKCDPVAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPVAEKCFDHAAGTSYVVGETWEKPYQGWMMVDCTCLGEGSGRITCTSRNRCNDQDTRTSYRIGDTWSKKDNRGNLLQCICTGNGRGEWKCERHTSVQTTSSGSGPFTDVRAAVYQPQPHPQPPPYGHCVTDSGVVYSVGMQWLKTQGNKQMLCTCLGNGVSCQETAVTQTYGGNSNGEPCVLPFTYNGRTFYSCTTEGRQDGHLWCSTTSNYEQDQKYSFCTDHTVLVQTRGGNSNGALCHFPFLYNNHNYTDCTSEGRRDNMKWCGTTQNYDADQKFGFCPMAAHEEICTTNEGVMYRIGDQWDKQHDMGHMMRCTCVGNGRGEWTCIAYSQLRDQCIVDDITYNVNDTFHKRHEEGHMLNCTCFGQGRGRWKCDPV

SEQ ID NO: 33383 - protein, 9 aa, Homo sapiens
ALLRAEETT

SEQ ID NO: 33384 - protein, 11 aa, Homo sapiens
RGHVPHWRSVG

SEQ ID NO: 33385 - protein, 20 aa, Homo sapiens
MLLGLPMWSEKRGRSPTKAG

SEQ ID NO: 33386 - protein, 13 aa, Homo sapiens
TTHSTSVMKRGTC

SEQ ID NO: 33387 - protein, 27 aa, Homo sapiens
MLWKKIKKVHLLSFNKKPLAPHAQGTE

SEQ ID NO: 33388 - protein, 58 aa, Homo sapiens
KVAAQNSTFLKLQTPSPSVTCNLVFSITSLSMLWKKIKKVHLLSFNKKPLAPHAQGTE

SEQ ID NO: 33389 - protein, 18 aa, Homo sapiens
MISALSLSLMAARVPLLH

SEQ ID NO: 33390 - protein, 27 aa, Homo sapiens
VFTLSRMTRKVSLSLIPSSQRCPNSLT

SEQ ID NO: 33391 - protein, 17 aa, Homo sapiens
LRQEKVSLFLKILWTPQ

SEQ ID NO: 33392 - protein, 16 aa, Homo sapiens
MWSASLLLMAERKVPY

SEQ ID NO: 33393 - protein, 103 aa, Homo sapiens
VSPVSTNNMRAHLLEEDRKQVLIPQLALTFLILLPTLLLCTGLLLEPPSLATGSAIIPSTSVGDLEKIGCPTLGIPSPSPTSLQAQSMWSASLLLMAERKVPY

SEQ ID NO: 33394 - protein, 16 aa, Homo sapiens
AWYRICSECLQCLRTT

SEQ ID NO: 33395 - protein, 16 aa, Homo sapiens
MFRGTWKLLLRPPPAY

SEQ ID NO: 33396 - protein, 53 aa, Homo sapiens
ATGSAIIPSTSVGDLEKIGCPTLGIPSPSPTSLQAQSMWSASLLLMAERKVPY

SEQ ID NO: 33397 - protein, 24 aa, Homo sapiens
LANNQQFLMFRGTWKLLLRPPPAY

SEQ ID NO: 33398 - protein, 17 aa, Homo sapiens
MDQDQQKLKLQVQIKQK

SEQ ID NO: 33399 - protein, 15 aa, Homo sapiens
QTIPDASDRCSGQQH

SEQ ID NO: 33400 - protein, 34 aa, Homo sapiens
MARLQSREPSSQMSEATPSQVYNQALTTRSTCTP

SEQ ID NO: 33401 - protein, 22 aa, Homo sapiens
QADQLRELSPLWRMSAHQEGLV

SEQ ID NO: 33402 - protein, 3828 aa, Homo sapiens
ALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKTAVPPPTDLRFTNIGPDTMRVTWAPPPSIDLTNFLVRYSPVKNEEDVAELSISPSDNAVVLTNLLPGTEYVVSVSSVYEQHESTPLRGRQKTGLDSPTGIDFSDITANSFTVHWIAPRATITGYRIRHHPEHFSGRPREDRVPHSRNSITLTNLTPGTEYVVSIVALNGREESPLLIGQQSTVSDVPRDLEVVAATPTSLLISWDAPAVTVRYYRITYGETGGNSPVQEFTVPGSKSTATISGLKPGVDYTITVYAVTGRGDSPASSKPISINYRTEIDKPSQMQVTDVQDNSISVKWLPSSSPVTGYRVTTTPKNGPGPTKTKTAGPDQTEMTIEGLQPTVEYVVSVYAQNPSGESQPLVQTAVTNIDRPKGLAFTDVDVDSIKIAWESPQGQVSRYRVTYSSPEDGIHELFPAPDGEEDTAELQGLRPGSEYTVSVVALHDDMESQPLIGTQSTAIPAPTDLKFTQVTPTSLSAQWTPPNVQLTGYRVRVTPKEKTGPMKEINLAPDSSSVVVSGLMVATKYEVSVYALKDTLTSRPAQGVVTTLENVSPPRRARVTDATETTITISWRTKTETITGFQVDAVPANGQTPIQRTIKPDVRSYTITGLQPGTDYKIYLYTLNDNARSSPVVIDASTAIDAPSNLRFLATTPNSLLVSWQPPRARITGYIIKYEKPGSPPREVVPRPRPGVTEATITGLEPGTEYTIYVIALKNNQKSEPLIGRKKT

SEQ ID NO: 33403 - protein, 15 aa, Homo sapiens
MAAATCQDYRLHHQV

SEQ ID NO: 33404 - protein, 89 aa, Homo sapiens
MTMLGAPLWSSTPPLPLMHHPTCVSWPPHPIPCWYHGSRHVPGLPATSSSMRSLGLLPEKWSLGPALVSQRLLLLAWNREPNIQFMSLP

SEQ ID NO: 33405 - protein, 26 aa, Homo sapiens
QWPDSNPENHQARCQKLHHHRFTTRH

SEQ ID NO: 33406 - protein, 15 aa, Homo sapiens
QCSELPCGHRRLHCH

SEQ ID NO: 33407 - protein, 129 aa, Homo sapiens
MSSFTFCGSFTGWKRHGAHIYLTMLLSIAIWVAWITLLMLPDFDRRWDDTILSSALAANGWVFLLAYVSPEFWLLTKQRNPMDYPVEDAFCKPQLVKKSYGVENRAYSQEEITQGPEWLQQSLMVAAMA

SEQ ID NO: 33408 - protein, 29 aa, Homo sapiens
IGPTSMSFLSFPLLVAMKTLSSCSPTSSS

SEQ ID NO: 33409 - protein, 190 aa, Homo sapiens
VILGLAVGFSLVQDVIAIEYIVLTMNRTNVNVFSELSAPRRNEDFVLLLTYVLFLMALTFLMSSFTFCGSFTGWKRHGAHIYLTMLLSIAIWVAWITLLMLPDFDRRWDDTILSSALAANGWVFLLAYVSPEFWLLTKQRNPMDYPVEDAFCKPQLVKKSYGVENRAYSQEEITQGPEWLQQSLMVAAMA

SEQ ID NO: 33410 - protein, 37 aa, Homo sapiens
MAGCSCWLMLVPSFGCSQSNETPWIILLRMLSVNLNS

SEQ ID NO: 33411 - protein, 17 aa, Homo sapiens
MCRRLCQGFWNKIECRV

SEQ ID NO: 33412 - protein, 26 aa, Homo sapiens
KNLPILFQTISSVDLIKLVFIHALIT

SEQ ID NO: 33413 - protein, 69 aa, Homo sapiens
LYLERSKLWDLKCLEYLLKKMVIVSTHLKKDRPLKMPLLLPMFLRLLLNLLIHPTRFKHQKSRVQPQHR

SEQ ID NO: 33414 - protein, 323 aa, Homo sapiens
MLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPENQ

SEQ ID NO: 33415 - protein, 381 aa, Homo sapiens
IQASEEQSSTPAPVKKSGKLRQQIDVKAELEKRQGGKQLLNLVVIGHVDAGKSTLMGHMLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPENQ

SEQ ID NO: 33416 - protein, 15 aa, Homo sapiens
RRNWRSGKEGSSYST

SEQ ID NO: 33417 - protein, 438 aa, Homo sapiens
MTVSGKKQTMGFEVPGVSSEENGHSFHTPQKGPPIEDAIASSDVLETASKSANPPHTIQASEEQSSTPAPVKKSGKLRQQIDVKAELEKRQGGKQLLNLVVIGHVDAGKSTLMGHMLYLLGNINKRTMHKYEQESKKAGKASFAYAWVLDETGEERERGVTMDVGMTKFETTTKVITLMDAPGHKDFIPNMITGAAQADVAVLVVDASRGEFEAGFETGGQTREHGLLVRSLGVTQLAVAVNKMDQVNWQQERFQEITGKLGHFLKQAGFKESDVGFIPTSGLSGENLITRSQSSELTKWYKGLCLLEQIDSFKPPQRSIDKPFRLCVSDVFKDQGSGFCITGKIEAGYIQTGDRLLAMPPNETCTVKGITLHDEPVDWAAAGDHVSLTLVGMDIIKINVGCIFCGPKVPIKACTRFRARILIFNIEIPITKGFPENQ

SEQ ID NO: 33418 - protein, 78 aa, Homo sapiens
KESLCMMNLSTGRQQAIMLVLLWLGWISSKSMLAAYFVAPKYPLKLALVSEPESSSLILKFLSLKDFLKTSRFPDIAK

SEQ ID NO: 33419 - protein, 23 aa, Homo sapiens
QISTSLLTTRASSSQLLQWSILL

SEQ ID NO: 33420 - protein, 32 aa, Homo sapiens
ASVFAPISVVECLLQCEETENRALWLGCFRTE

SEQ ID NO: 33421 - protein, 51 aa, Homo sapiens
QRQILYPQQNPPSHTRASQLLSPGSKFQHPCLRPGPPPPSSCSGAYCCNSR

SEQ ID NO: 33422 - protein, 419 aa, Homo sapiens
QVFSPPSVSSSAFCSAKKLKIEPSGWDVSGQSSNDKYYTHSKTLPATQGQANSSHQVANFNIPAYDQGLLLPAPAVEHIVVTAADSSGSAATSTFQSSQTLTHRSNVSLLEPYQKCGLKRKSEEVDSNGSVQIIEEHPPLMLQNRTVVGAAATTTTVTTKSSSSSGEGDYQLVQHEILCSMTNSYEVLEFLGRGTFGQVAKCWKRSTKEIVAIKILKNHPSYARQGQIEVSILSRLSSENADEYNFVRSYECFQHKNHTCLVFEMLEQNLYDFLKQNKFSPLPLKYIRPILQQVATALMKLKSLGLIHADLKPENIMLVDPVRQPYRVKVIDFGSASHVSKAVCSTYLQSRYYRAPEIILGLPFCEAIDMWSLGCVIAELFLGWPLYPGASEYDQVWHHSCKCFRPHQCRRVPSAVRRN

SEQ ID NO: 33423 - protein, 47 aa, Homo sapiens
RSLTLVLLVTFPKLCAQPTYSHVTTELLKLFLGYHFVKLLICGHWAV

SEQ ID NO: 33424 - protein, 32 aa, Homo sapiens
MLVLPMLSDNNNPVPSLRRRISSQLQSLPSPL

SEQ ID NO: 33425 - protein, 22 aa, Homo sapiens
LTGGMPTLMATSTALSCSSHPC

SEQ ID NO: 33426 - protein, 22 aa, Homo sapiens
LEECPLSWQPVQHYHAAAILAD

SEQ ID NO: 33427 - protein, 17 aa, Homo sapiens
MSSVMSLSMILQTLTLL

SEQ ID NO: 33428 - protein, 8 aa, Homo sapiens
AALIPLIP

SEQ ID NO: 33429 - protein, 31 aa, Homo sapiens
VLSEAIVDPFWRGLAELWQMALAPALSLCLH

SEQ ID NO: 33430 - protein, 74 aa, Homo sapiens
ISYVTVNDSPDSDSSLSSPYSTDTLSALRGNSGSVLEGPGRVVADGTGTRTIIVPPLKTQLGDCTVATQASALD

SEQ ID NO: 33431 - protein, 3073 aa, Homo sapiens
MDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPS

SEQ ID NO: 33432 - protein, 3085 aa, Homo sapiens
QATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPS

SEQ ID NO: 33433 - protein, 10 aa, Homo sapiens
KQQQSILDSL

SEQ ID NO: 33434 - protein, 2965 aa, Homo sapiens
MGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPSRAPEIILGLPFCEAIDMWSLGCVIAELFLGWPLYPGASEYDQIRYISQTQGLPAEYLLSAGTKTTRFFNRDPNLGYPLWRLKTPEEHELETGIKSKEARKYIFNCLDDMAQVNMSTDLEGTDMLAEKADRREYIDLLKKMLTIDADKRITPLKTLNHQFVTMTHLLDFPHSNHVKSCFQNMEICKRRVHMYDTVSQIKSPFTTHVAPNTSTNLTMSFSNQLNTVHNQASVLASSSTAAAATLSLANSDVSLLNYQSALYPSSAAPVPGVAQQGVSLQPGTTQICTQTDPFQQTFIVCPPAFQTGLQATTKHSGFPVRMDNAVPIVPQAPAAQPLQIQSGVLTQGSCTPLMVATLHPQVATITPQYAVPFTLSCAAGRPALVEQTAAVLQAWPGGTQQILLPSTWQQLPGVALHNSVQPTAMIPEAMGSGQQLADWRNAHSHGNQYSTIMQQPSLLTNHVTLATAQPLNVGVAHVVRQQQSSSLPSKKNKQSAPVSSKSSLDVLPSQVYSLVGSSPLRTTSSYNSLVPVQDQHQPIIIPDTPSPPVSVITIRSDTDEEEDNKYKPS

SEQ ID NO: 33435 - protein, 38 aa, Homo sapiens
AAQPAGRRWLNRLPLYCRRGLEGLSKFSCLQLGNSCLG

SEQ ID NO: 33436 - protein, 20 aa, Homo sapiens
MRSDRPLHAGAVRPLQSGKI

SEQ ID NO: 33437 - protein, 13 aa, Homo sapiens
KTHTESYAHHLSL

SEQ ID NO: 33438 - protein, 159 aa, Homo sapiens
QLNYRGGTPYNNERHTPRATLITFLCDRDAGVGFPEYQEEDNSTYNFRWYTSYACPEEPLECVVTDPSTLEQYDLSSLAKSEGGLGGNWYAMDNSGEHVTWRKYYINVCRPLNPVPGCNRYASACQMKYEKDQGFLLTYHLSQRKMVPIKLRQRSMTFI

SEQ ID NO: 33439 - protein, 12 aa, Homo sapiens
AQELEASKASRN

SEQ ID NO: 33440 - protein, 8 aa, Homo sapiens
MGERGLSI

SEQ ID NO: 33441 - protein, 243 aa, Homo sapiens
LHQDIDSGQGIRNTYFEFETALACVPSPVDCQVTDLAGNEYDLTGLSTVRKPWTAVDTSVDGRKRTFYLSVCNPLPYIPGCQGSAVGSCLVSEGNSWNLGVVQMSPQAAANGSLSIMYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAV

SEQ ID NO: 33442 - protein, 22 aa, Homo sapiens
AQSGNLGRLLTPLSMGERGLSI

SEQ ID NO: 33443 - protein, 127 aa, Homo sapiens
MYVNGDKCGNQRFSTRITFECAQISGSPAFQLQDGCEYVFIWRTVEACPVVRVEGDNCEVKDPRHGNLYDLKPLGLNDTIVSAGEYTYYFRVCGKLSSDVCPTSDKSKVVSSCQEKREPQGFHKVAV

SEQ ID NO: 33444 - protein, 25 aa, Homo sapiens
LESGCGADESPSRGEWIFEHHVCQR

SEQ ID NO: 33445 - protein, 10 aa, Homo sapiens
LSMGERGLSI

SEQ ID NO: 33446 - protein, 61 aa, Homo sapiens
ASCMSTVTSVGTSASPPGSRLSVLRYRAHQHFSFRMVVSTCLSGELWKPVPLSEWKGTTVR

SEQ ID NO: 33447 - protein, 13 aa, Homo sapiens
QVWEPALLHQDHV

SEQ ID NO: 33448 - protein, 16 aa, Homo sapiens
VCSDIGLTSISASGWL

SEQ ID NO: 33449 - protein, 29 aa, Homo sapiens
MSASLWPRRLALSRALQKQPRVCWVAPSP

SEQ ID NO: 33450 - protein, 13 aa, Homo sapiens
VANAVCLPTFRSD

SEQ ID NO: 33451 - protein, 20 aa, Homo sapiens
MFIQRWGWQLLRPLVPVKVQ

SEQ ID NO: 33452 - protein, 28 aa, Homo sapiens
QLGSHHWDGGPGALPHQCLQVSGPAGWH

SEQ ID NO: 33453 - protein, 234 aa, Homo sapiens
KETSDCSYLFEWRTQYACPPFDLTECSFKDGAGNSFDLSSLSRYSDNWEAITGTGDPEHYLINVCKSLAPQAGTEPCPPEAAACLLGGSKPVNLGRVRDGPQWRDGIIVLKYVDGDLCPDGIRKKSTTIRFTCSESQVNSRPMFISAVEDCEYTFAWPTATACPMKSNEHDDCQVTNPSTGHLFDLSSLSGRAGFTAAYSEKGLVYMSICGENENCPPGVASISKGDFRLFLLV

SEQ ID NO: 33454 - protein, 22 aa, Homo sapiens
RRLQIVPTCLSGERSMPAHLSI

SEQ ID NO: 33455 - protein, 68 aa, Homo sapiens
LNVHSKMGLATPSTSRPCQGTVTTGKPSLGRGTRSTTSSMSASLWPRRLALSRALQKQPRVCWVAPSP

SEQ ID NO: 33456 - protein, 34 aa, Homo sapiens
MSRWDSEKVNHHPIHLQREPSELQAHVHQRRGGL

SEQ ID NO: 33457 - protein, 16 aa, Homo sapiens
ALPHQCLQVSGPAGWH

SEQ ID NO: 33458 - protein, 38 aa, Homo sapiens
AVPSRSSRVSAGWLQAREPRQGKGRTSVERWHNCPEIR

SEQ ID NO: 33459 - protein, 28 aa, Homo sapiens
MSICGENENCPPGVASISKGDFRLFLLV

SEQ ID NO: 33460 - protein, 12 aa, Homo sapiens
LPGHQPKHRTPV

SEQ ID NO: 33461 - protein, 78 aa, Homo sapiens
MSCLPLPLSAERIRPSLFLPPSSSTVTLWWRTGSPSSVTRLPTASTSSLGTPQPCVLWGLISTAALTTSAGTPGLPAP

SEQ ID NO: 33462 - protein, 17 aa, Homo sapiens
AVQSLWGHEDQWGQLPV

SEQ ID NO: 33463 - protein, 19 aa, Homo sapiens
QDQVLPSRRRSRCRVCLFL

SEQ ID NO: 33464 - protein, 995 aa, Homo sapiens
KLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPL

SEQ ID NO: 33465 - protein, 843 aa, Homo sapiens
MVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPL

SEQ ID NO: 33466 - protein, 17 aa, Homo sapiens
QVLPSRRRSRCRVCLFL

SEQ ID NO: 33467 - protein, 937 aa, Homo sapiens
KYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPLGFDIDSCTYYFSWDSRAACAVKPQEVQMVNGTITNPINGKSFSLGDIYFKLFRASGDMRTNGDNYLYEIQLSSITSSRNPACSGANICQVKPNDQHFSRKVGTSDKTKYYLQDGDLDVVFASSSKCGKDKTKSVSSTIFFHCDPLVEDGIPEFSHETADCQYLFSWYTSAVCPL

SEQ ID NO: 33468 - protein, 6583 aa, Homo sapiens
MTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECR

SEQ ID NO: 33469 - protein, 31 aa, Homo sapiens
ILTAISLKMWSLHLLQTALRFGGNLKMVWKM

SEQ ID NO: 33470 - protein, 8 aa, Homo sapiens
ASAHAGLT

SEQ ID NO: 33471 - protein, 34 aa, Homo sapiens
LDVSATKWNLVTTLPPWITTSMKRRKPTWGLGLA

SEQ ID NO: 33472 - protein, 6113 aa, Homo sapiens
MEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECR

SEQ ID NO: 33473 - protein, 31 aa, Homo sapiens
MMTTRWCHYHQAQDMSSFLGRCALRREQTTR

SEQ ID NO: 33474 - protein, 8 aa, Homo sapiens
RGLFGVFH

SEQ ID NO: 33475 - protein, 42 aa, Homo sapiens
QHTIFHGVRHPNSLRATATRPLGKSCHHSAATWKDSNQQPMW

SEQ ID NO: 33476 - protein, 6135 aa, Homo sapiens
AGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECR

SEQ ID NO: 33477 - protein, 29 aa, Homo sapiens
VPSARICQCLLQSRHWPVPLFPGSVCSAV

SEQ ID NO: 33478 - protein, 18 aa, Homo sapiens
LRPSDWGVLELPGLHHGS

SEQ ID NO: 33479 - protein, 43 aa, Homo sapiens
MGHNCESLFSCHTVNHWTSSPWEVQEMGWSPTVPGKPFRDTDV

SEQ ID NO: 33480 - protein, 5830 aa, Homo sapiens
MGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECR

SEQ ID NO: 33481 - protein, 50 aa, Homo sapiens
KVLGWLLWRPHHWVRRSLPPLPLPRWSRQWTPVCQELLPRSCYFTACLCL

SEQ ID NO: 33482 - protein, 27 aa, Homo sapiens
QGDWEVSQVPVPHGRGTLSVLPVWILW

SEQ ID NO: 33483 - protein, 14 aa, Homo sapiens
LPVRQSHWSVLVSS

SEQ ID NO: 33484 - protein, 5729 aa, Homo sapiens
KETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECRALCRARVRAQEPEFSYGCAEGSCYPATGDLLIGRAQKLSVTSTCGLHKPEPYCIVSHLQEDKKCFICNSQDPYHETLNPDSHLIENVVTTFAPNRLKIWWQSENGVENVTIQLDLEAEFHFTHLIMTFKTFRPAAMLIERSSDFGKTWGVYRYFAYDCEASFPGISTGPMKKVDDIICDSRYSDIEPSTEGEVIFRALDPAFKIEDPYSPRIQNLLKITNLRIKFVKLHTLGDNLLDSRMEIREKYYYAVYDMVVRGNCFCYGHASECAPVDGFNEEVEGMVHGHCMCRHNTKGLNCELCMDFYHDLPWRPAEGRNSNACKKCNCNEHSISCHFDMAVYLATGNVSGGVCDDCQHNTMGRNCEQCKPFYYQHPERDIRDPNFCERCTCDPAGSQNEGICDSYTDFSTGLIAGQCRCKLNVEGEHCDVCKEGFYDLSSEDPFGCKSCACNPLGTIPGGNPCDSETGHCYCKRLVTGQHCDQCLPEHWGLSNDLDGCRPCDCDLGGALNNSCFAESGQCSCRPHMIGRQCNEVEPGYYFATLDHYLYEAEEANLGPGVSIVERQYIQDRIPSWTGAGFVRVPEGAYLEFFIDNIPYSMEYDILIRYEPQLPDHWEKAVITVQRPGRIPTSSRCGNTIPDDDNQVVSLSPGSRYVVLPRPVCFEKGTNYTVRLELPQYTSSDSDVESPYTLIDSLVLMPYCKSLDIFTVGGSGDGVVTNSAWETFQRYRCLENSRSVVKTPMTDVCRNIIFSISALLHQTGLACECDPQGSLSSVCDPNGGQCQCRPNVVGRTCNRCAPGTFGFGPSGCKPCECHLQGSVNAFCNPVTGQCHCFQGVYARQCDRCLPGHWGFPSCQPCQCNGHADDCDPVTGECLNCQDYTMGHNCERCLAGYYGDPIIGSGDHCRPCPCPDGPDSGRQFARSCYQDPVTLQLACVCDPGYIGSRCDDCASGYFGNPSEVGGSCQPCQCHNNIDTTDPEACDKETGRCLKCLYHTEGEHCQFCRFGYYGDALQQDCRKCVCNYLGTVQEHCNGSDCQCDKATGQCLCLPNVIGQNCDRCAPNTWQLASGTGCDPCNCNAAHSFGPSCNEFTGQCQCMPGFGGRTCSECQELFWGDPDVECR

SEQ ID NO: 33485 - protein, 23 aa, Homo sapiens
AREGTRGSSLTAHPATSALLSGM

SEQ ID NO: 33486 - protein, 42 aa, Homo sapiens
LHTLPPVLCSLGCDHCRADQQDTQIPGESQGLEDQWCDRALP

SEQ ID NO: 33487 - protein, 288 aa, Homo sapiens
TRGYSGVFPDCTPCHQCFALWDVIIAELTNRTHRFLEKAKALKISGVIGPYRETVDSVERKVSEIKDILAQSPAAEPLKNIGNLFEEAEKLIKDVTEMMAQVEVKLSDTTSQSNSTAKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMPVTVTPGALRRHSVTSPRASVSALRVLRVHAVTSAREGTRGSSLTAHPATSALLSGM

SEQ ID NO: 33488 - protein, 127 aa, Homo sapiens
MSLEAEERVNASTTEPNSTVEQSALMRDRVEDVMMERESQFKEKQEEQARLLDELAGKLQSLDLSAAAEMPVTVTPGALRRHSVTSPRASVSALRVLRVHAVTSAREGTRGSSLTAHPATSALLSGM

SEQ ID NO: 33489 - protein, 12 aa, Homo sapiens
KTSWRRAPQQSH

SEQ ID NO: 33490 - protein, 102 aa, Homo sapiens
MRDRVEDVMMERESQFKEKQEEQARLLDELAGKLQSLDLSAAAEMPVTVTPGALRRHSVTSPRASVSALRVLRVHAVTSAREGTRGSSLTAHPATSALLSGM

SEQ ID NO: 33491 - protein, 35 aa, Homo sapiens
KNLLNNWNLSKTQIFGVPWIALPSISRCLLRQRRG

SEQ ID NO: 33492 - protein, 16 aa, Homo sapiens
MPPPQNPTALWSSQPS

SEQ ID NO: 33493 - protein, 48 aa, Homo sapiens
GRGEGECLHHRTQQHCGAVSPHERQSRRRDDGARIPVQGKTRGAGSPP

SEQ ID NO: 33494 - protein, 172 aa, Homo sapiens
AKELDSLQTEAESLDNTVKELAEQLEFIKNSDIRGALDSITKYFQMSLEAEERVNASTTEPNSTVEQSALMRDRVEDVMMERESQFKEKQEEQARLLDELAGKLQSLDLSAAAEMPVTVTPGALRRHSVTSPRASVSALRVLRVHAVTSAREGTRGSSLTAHPATSALLSGM

SEQ ID NO: 33495 - protein, 25 aa, Homo sapiens
MGLSVKCRYTPGLCLSQPFSSLFSP

SEQ ID NO: 33496 - protein, 89 aa, Homo sapiens
APAMSDSSPSVTCCRVQPSWWLSPTAGFWRPWPAPCTLSSSATCCSLMWLLSSHFGSCCISSFTMGLSVKCRYTPGLCLSQPFSSLFSP

SEQ ID NO: 33497 - protein, 24 aa, Homo sapiens
AQPQGSGDPGQLPAHSQVPPPAVL

SEQ ID NO: 33498 - protein, 23 aa, Homo sapiens
MKGPSYWAHVGPAGMLLSDVLQP

SEQ ID NO: 33499 - protein, 51 aa, Homo sapiens
VLASGNQGLVAHPAASVERPPEAGPHPEMKGPSYWAHVGPAGMLLSDVLQP

SEQ ID NO: 33500 - protein, 20 aa, Homo sapiens
ASAHSPWGCQSSVAILLACA

SEQ ID NO: 33501 - protein, 39 aa, Homo sapiens
MRLLAPSGHLLLQQPPPLPLLLHPHTNGHQLAQPHSLSP

SEQ ID NO: 33502 - protein, 15 aa, Homo sapiens
RVPLIGLTSAPPGCC

SEQ ID NO: 33503 - protein, 64 aa, Homo sapiens
MTSFLLWLARRRMAKRWRLGKWLVELWMDQIPAAWGFQHWKLHKDSAASPPWSYSQFHSPQRQP

SEQ ID NO: 33504 - protein, 29 aa, Homo sapiens
GSWHQAVTFCSSSHLLCLFFYILIQTGTS

SEQ ID NO: 33505 - protein, 24 aa, Homo sapiens
APKAFQASCREEGCSHPSGAWCRV

SEQ ID NO: 33506 - protein, 9 aa, Homo sapiens
MSPPCPASQ

SEQ ID NO: 33507 - protein, 23 aa, Homo sapiens
APGCHWRASHSPTMAWALTSSAC

SEQ ID NO: 33508 - protein, 26 aa, Homo sapiens
MSLRRRSWLPYLRRRLLWLLLLGRRA

SEQ ID NO: 33509 - protein, 9 aa, Homo sapiens
VPCTAGSRH

SEQ ID NO: 33510 - protein, 15 aa, Homo sapiens
MSMVQQQRPRLWRRD

SEQ ID NO: 33511 - protein, 67 aa, Homo sapiens
KFAPAAAPAESSVACGWRKECAHHQCPPLRQQCPPPWEHHWLCAQCRCLCQVLSPPPVEHPLSVWDR

SEQ ID NO: 33512 - protein, 62 aa, Homo sapiens
MCSSPVPSLTSTMSPTLGTSLVVCSVPMSLPGTLASASGTPSICVGQMSMVQQQRPRLWRRD

SEQ ID NO: 33513 - protein, 28 aa, Homo sapiens
ADQNHPGHFPAVAETRFCAARYCGATAM

SEQ ID NO: 33514 - protein, 11 aa, Homo sapiens
QVWQAHQCCRA

SEQ ID NO: 33515 - protein, 285 aa, Homo sapiens
MLSSLRSLSVKSADHALWCSRASTCFWTCLRLPVAGERNVLITSALPYVNNVPHLGNIIGCVLSADVFARYSRLRQWNTLYLCGTDEYGTATETKALEEGLTPQEICDKYHIIHADIYRWFNISFDIFGRTTTPQQTKITQDIFQQLLKRGFVLQDTVEQLRCEHCARFLADRFVEGVCPFCGYEEARGDQCDKCGKLINAVELKKPQCKVCRSCPVVQSSQHLFLDLPKVACGWRKECAHHQCPPLRQQCPPPWEHHWLCAQCRCLCQVLSPPPVEHPLSVWDR

SEQ ID NO: 33516 - protein, 18 aa, Homo sapiens
MPSLSPVLGFGMASSHAA

SEQ ID NO: 33517 - protein, 16 aa, Homo sapiens
AGEATGGVVGEDIAWQ

SEQ ID NO: 33518 - protein, 37 aa, Homo sapiens
LDTQCPVYHPFLASGWPQATLHNPRPQMGNPCTLRRF

SEQ ID NO: 33519 - protein, 69 aa, Homo sapiens
MGIYSIKKFGLTTSRGRDRVGVGIRSSYIRVLGIQVDTDGSEIRLGAPNAHWTRTSSCPTNANAWTSRP

SEQ ID NO: 33520 - protein, 32 aa, Homo sapiens
GWAPQMPIGPVLHHARQMQMRGLPDPEAAGAA

SEQ ID NO: 33521 - protein, 27 aa, Homo sapiens
QGRPWEQGYHHGHLLHQEVWPDYQQGP

SEQ ID NO: 33522 - protein, 133 aa, Homo sapiens
AGRPKCPLDPYFIMPDKCKCVDFQTLKLQELPDAVPHGEMPRHMQLYCDRYLCDKVVPGNRVTIMGIYSIKKFGLTTSRGRDRVGVGIRSSYIRVLGIQVDTDGSEIRLGAPNAHWTRTSSCPTNANAWTSRP

SEQ ID NO: 33523 - protein, 25 aa, Homo sapiens
LGAPNAHWTRTSSCPTNANAWTSRP

SEQ ID NO: 33524 - protein, 305 aa, Homo sapiens
MLGDPGTAKSQLLKFVEKCSPIGVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGTCVTRSSLGTGLPSWASTPSRSLA

SEQ ID NO: 33525 - protein, 31 aa, Homo sapiens
RRRSSVAWLPSQMSMRSSPRASPPPSLGAQT

SEQ ID NO: 33526 - protein, 250 aa, Homo sapiens
MVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGTCVTRSSLGTGLPSWASTPSRSLA

SEQ ID NO: 33527 - protein, 69 aa, Homo sapiens
QPADARGPWDSQVPASEVCGEVFSHWGIHVWERQQRSWTDSLGDEGPFVPEFHHGGRSHGPGRWWGRLY

SEQ ID NO: 33528 - protein, 1613 aa, Homo sapiens
MRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQVYTSGKGSSAAGLTASVMRDPSSRNFIMEGGAMVLADGGVVCIDEFDKMREDDRVAIHEAMEQQTISIAKAGITTTLNSRCSVLAAANSVFGRWDETKGEDNIDFMPTILSRFDMIFIVKDEHNEERDVMLAKHVITLHVSALTQTQAVEGEIDLAKLKKFIAYCRVKCGPRLSAEAAEKLKNRYIIMRSGARQHERDSDRRSSIPITVRQLEAIVRIAEALSKMKLQPFATEADVEEALRLFQVSTLDAALSGTLSGVEGFTSQEDQEMLSRIEKQLKRRFAIGSQVSEHSIIKDFTKQ

SEQ ID NO: 33529 - protein, 14 aa, Homo sapiens
MAAPSLCSPSPRLS

SEQ ID NO: 33530 - protein, 11 aa, Homo sapiens
AGARAGTEEGQ

SEQ ID NO: 33531 - protein, 240 aa, Homo sapiens
IPVVTNSPQPLPPPPPLPAAAQPLPLAPRQPALVGAPGLSIKEPAPLPSRPQVPTPAPLLPDSKATIPPNGSPKPLQPLPTPVLTIAPHPGVQPQLAPQQPPPPTLGTLKLAPAEEVKSSEQKKRPGGIGTREVHNKLEKNRRAHLKECFETLKRNIPNVDDKKTSNLSVLRTALRYIQRSRSGFAWSRSESRNRRRPIAWPGWHIPFLWRNPAWRRHPCLCLHRLPRRHPHHHLPPLPH

SEQ ID NO: 33532 - protein, 10 aa, Homo sapiens
MMKTLRRKSE

SEQ ID NO: 33533 - protein, 9 aa, Homo sapiens
QRLFLLPHF

SEQ ID NO: 33534 - protein, 38 aa, Homo sapiens
RLRLQLNSLPLASPLLTTTIPITTFLKHKMSPVMFHTL

SEQ ID NO: 33535 - protein, 23 aa, Homo sapiens
KVNLRKLSKNSYTIQTCTCSSRN

SEQ ID NO: 33536 - protein, 26 aa, Homo sapiens
IRSPEDATSDTLSSSRRSAGCDQTGI

SEQ ID NO: 33537 - protein, 2356 aa, Homo sapiens
RSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQ

SEQ ID NO: 33538 - protein, 45 aa, Homo sapiens
IRKLLLLTPLGRGQSEYPTVHADLACGRCTEYSYKLRFNGTSIRR

SEQ ID NO: 33539 - protein, 22 aa, Homo sapiens
IPNCSRRPRLWQMHRIFLQAPF

SEQ ID NO: 33540 - protein, 2238 aa, Homo sapiens
MAPASEDEDNVLKAFTVPKNRSLASPLQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQRHYNDEDPEKEKRIKELELLLMSTENELKGQQVLPTQNHTCSYPGWHSTTIADHTRPHGDSAPVSCLGEHHSTPSLPADPGSLPEESASPARCMIVHQGTILDNVKNLLEFAETLQFIDSDSSSWCDLSSFEFFEEADFSPSQHHTGKALQLQQREGNGTKPAGEPSPRVNKRMLSESSLDPPKVLPPARHSTIPLVILRKKRGQASPLATGDCSSFIFADVSSSTPKRSPVKSLPFSPSQFLNTSSNHENSDLEMPSLTSTPLIGHKLTVTTPFHRDQTVKTQKENTVFRTPAIKRSILESSPRTPTPFKHALAAQEIKYGPLKMLPQTPSHLVEDLQDVIKQESDESGIVAEFQENGPPLLKKIKQEVESPTDKSGNFFCSHHWEGDSLNTQLFTQTSPVADAPNILTSSVLMAPASEDEDNVLKAFTVPKNRSLASPLQ

SEQ ID NO: 33541 - protein, 33 aa, Homo sapiens
ASIRGHPGGGIVGRGRSGSFSGDAAGSYSHYGA

SEQ ID NO: 33542 - protein, 28 aa, Homo sapiens
GHLTRWGTDRLVWGNRSSRRSTYWSPRC

SEQ ID NO: 33543 - protein, 114 aa, Homo sapiens
QASEATQAVASLAEAAVAASQEMQQGATVTMALNSEAAAHAVATLAEATLQGGGQIVLSGETAAAVGALTGVQDANVELHGGTRSDPNRTYGYHRSTCSGPASAAGPCGYLHRA

SEQ ID NO: 33544 - protein, 491 aa, Homo sapiens
MLMNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQAQLRAFIPEMLKYSTGRGKPGWGKESCKPIWWPEDIPWANVRSDVRTEEQKQRVSWTQALRTIVKNCYKQHGREDLLYAFEDQQTQTQATATHSIAHLVPSQTVVQTFSNPDGTVSLIQVGTGATVATLADASELPTTVTVAQVNYSAVADGEVEQNWATLQGGEMTIQTTQASEATQAVASLAEAAVAASQEMQQGATVTMALNSEAAAHAVATLAEATLQGGGQIVLSGETAAAVGALTGVQDANELHGGTRSDPNRTYGYHRSTCSGPASAAGPCGYLHRA

SEQ ID NO: 33545 - protein, 564 aa, Homo sapiens
KHQRPPRRWHRWQRPQWQLLRRCSRELQSLWRLTAKLPPMLSPPWLRPPYKVGDRSSCLGKPQQPSEHLLESKMLMNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQAQLRAFIPEMLKYSTGRGKPGWGKESCKPIWWPEDIPWANVRSDVRTEEQKQRVSWTQALRTIVKNCYKQHGREDLLYAFEDQQTQTQATATHSIAHLVPSQTVVQTFSNPDGTVSLIQVGTGATVATLADASELPTTVTVAQVNYSAVADGEVEQNWATLQGGEMTIQTTQASEATQAVASLAEAAVAASQEMQQGATVTMALNSEAAAHAVATLAEATLQGGGQIVLSGETAAAVGALTGVQDANELHGGTRSDPNRTYGYHRSTCSGPASAAGPCGYLHRA

SEQ ID NO: 33546 - protein, 28 aa, Homo sapiens
VLMKTRLLLPRTPLTMTQIYSTPQQLMR

SEQ ID NO: 33547 - protein, 15 aa, Homo sapiens
GPASAAGPCGYLHRA

SEQ ID NO: 33548 - protein, 1144 aa, Homo sapiens
MAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQ

SEQ ID NO: 33549 - protein, 1203 aa, Homo sapiens
VAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQNFMEEHGVTQTEHMATIEAHAVAQQVQQVHVATYTEHSMLSADEDSPSSPEDTSYDDSDILNSTAADEVTAHLAAAGPVGMAAAAAVATGKKRKRPHVFESNPSIRKRQQTRLLRKLRATLDEYTTRVGQQAIVLCISPSKPNPVFKVFGAAPLENVVRKYKSMILEDLESALAEHAPAPQEVNSELPPLTIDGIPVSVDKMTQ

SEQ ID NO: 33550 - protein, 34 aa, Homo sapiens
LKTVPWEVLQTQWQGFFGDVWKTCRKLIAFPKSS

SEQ ID NO: 33551 - protein, 37 aa, Homo sapiens
AHHFSGSPNGLITLTNMALGTSSQTTPSVSFSTMVLT

SEQ ID NO: 33552 - protein, 18 aa, Homo sapiens
LHSQRAAEHIISVGHQMG

SEQ ID NO: 33553 - protein, 170 aa, Homo sapiens
QIWLWVPALRPHRRCPFQQWCSHEPPSRQKELQPPTTTVARSGTPAVENKQQIGDAIRMIVRGTLGSCSSSSECLEDSTMGSVADTVARVLRGCLENMPEADCIPKEQLSTSFQWVTKWVDYSNKYGFGYQLSDHTVGVLFNNGAHMSLLPDKKSSSHLPPQLPGLEHPQ

SEQ ID NO: 33554 - protein, 125 aa, Homo sapiens
MARSSRLGARRHNQHHLVAMVDTESPLCPLSPLEAGDLESPLSEEFLQEMGNIQEISQSIGEDSSGSFGFTEYQYLGSCPGSDGSVITAWSSAAQPAPSGRDGGHGKPTLPPLPTRGRRSREPVI

SEQ ID NO: 33555 - protein, 17 aa, Homo sapiens
MARSSRTRFHQLRAPPR

SEQ ID NO: 33556 - protein, 253 aa, Homo sapiens
MTSATAAARSRKRTETNASIVDFTSAFLSGCHTTLGARRHNQHHLVAMVDTESPLCPLSPLEAGDLESPLSEEFLQEMGNIQEISQSIGEDSSGSFGFTEYQYLGSCPGSDGSVITDTLSPASSPSSVTYPVVPGSVDESPSGALNIECRICGDKASGYHYGVHACEGCKGFFRRTIRLKLVYDKCDRSCKIQKKNRNKCQYCRFHKCLSVGMSHNAWSSAAQPAPSGRDGGHGKPTLPPLPTRGRRSREPVI

SEQ ID NO: 33557 - protein, 588 aa, Homo sapiens
MNKVKARVILSGKASNNPGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNP

SEQ ID NO: 33558 - protein, 10 aa, Homo sapiens
KQKFLPVNMT

SEQ ID NO: 33559 - protein, 19 aa, Homo sapiens
KILKLQISNLWPRESTRPT

SEQ ID NO: 33560 - protein, 663 aa, Homo sapiens
IQKKNRNKCQYCRFHKCLSVGMSHNAIRFGRMPRSEKAKLKAEILTCEHDIEDSETADLKSLAKRIYEAYLKNFNMNKVKARVILSGKASNNPGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNPGFFRRTIRLKLVYDKCDRSCKIQKKNRNKCQYCRFHKCLSVGMSHNAIRFGRMPRSEKAKLKAEILTCEHDIEDSETADLKSLAKRIYEAYLKNFNMNKVKARVILSGKASNNP

SEQ ID NO: 33561 - protein, 72 aa, Homo sapiens
MLSSVMNKDGMLVAYGNGFITREFLKSLRKPFCDIMEPKFDFAMKFNALELDDSDISLFVAAIICCGAFCHT

SEQ ID NO: 33562 - protein, 54 aa, Homo sapiens
QWHPEQGGGGPHLSLLPVHVSGDRHGAHGIRQGHPRLRKLGPERSSDIAKIRSL

SEQ ID NO: 33563 - protein, 26 aa, Homo sapiens
GHIRHAVFCDEQRRDAGSVWKWVYNS

SEQ ID NO: 33564 - protein, 69 aa, Homo sapiens [sequence omitted]

SEQ ID NO: 33565 - protein, 69 aa, Homo sapiens
AAGDGACAAGADHQEDGVGCCAAPATAGDLQGHVLSSFRSATPFPGVLKLTALQRRRGSSTILHKYPPL

SEQ ID NO: 33566 - protein, 100 aa, Homo sapiens
MPTGKMQLPSQGLSPRPRRPPLRKSPWLSRQPPTPRQQRGSVCWKKWKSSPGRRRRAMCYRCSASCLSLTRPHSPGWREAGGCSDSMTWRPPMTAHYSPD

SEQ ID NO: 33567 - protein, 33 aa, Homo sapiens
MRAWTKPTWRMLDTPAQTRQPQRTISSSISVPV

SEQ ID NO: 33568 - protein, 21 aa, Homo sapiens
MLPRKGCGKTQFFLKFCLNSQ

SEQ ID NO: 33569 - protein, 11 aa, Homo sapiens
KLCQCTSILNY

SEQ ID NO: 33570 - protein, 8 aa, Homo sapiens
ALPVHVHT

SEQ ID NO: 33571 - protein, 31 aa, Homo sapiens
MQATRMHQNILCIFWRYIDLPSKALPVHVHT

SEQ ID NO: 33572 - protein, 15 aa, Homo sapiens
LHPPGYCFIKTMCRI

SEQ ID NO: 33573 - protein, 150 aa, Homo sapiens
MRIKHLLKSNCIPQATALSKLCAESKEISNVSSFQQAYITCLCSMLPNEDAIKEIAKVDCKEVLDIICNLESEGQDNTAFVLCTTYLTQQLQTASVYCSWELTLFWSKLQRRIDPSLDTFLERCRQFGVIAKTQQHLFCLIRVIQTESIN

SEQ ID NO: 33574 - protein, 144 aa, Homo sapiens
LKSNCIPQATALSKLCAESKEISNVSSFQQAYITCLCSMLPNEDAIKEIAKVDCKEVLDIICNLESEGQDNTAFVLCTTYLTQQLQTASVYCSWELTLFWSKLQRRIDPSLDTFLERCRQFGVIAKTQQHLFCLIRVIQTESIN

SEQ ID NO: 33575 - protein, 38 aa, Homo sapiens
MAPPHHPMASAMGLPLLPPPLWLINSCPQPVVPGNSAS

SEQ ID NO: 33576 - protein, 27 aa, Homo sapiens
ADSSNNATSPNYSRSSKNQFIYTDNVN

SEQ ID NO: 33577 - protein, 22 aa, Homo sapiens
MNSCFWMPAPPHLLTPQSCFSM

SEQ ID NO: 33578 - protein, 16 aa, Homo sapiens
QLKNFIPNCKKLLTSH

SEQ ID NO: 33579 - protein, 33 aa, Homo sapiens
MISVKRNTWRALSLVIGDCRKKGNFEYCQEQEA

SEQ ID NO: 33580 - protein, 50 aa, Homo sapiens
RPTCPCCSVSSSTAQDWPNRTLPSTSPSMNSCFWMPAPPHLLTPQSCFSM

SEQ ID NO: 33581 - protein, 9 aa, Homo sapiens
ISFQTARSY

SEQ ID NO: 33582 - protein, 19 aa, Homo sapiens
APPLRKTGQTEPCPVPRPA

SEQ ID NO: 33583 - protein, 60 aa, Homo sapiens
TAYPTSPMACLTLPHLHLSITVWMIWPLPTTTGTPIDTPATGTSGTETDLWGCMAHVKKK

SEQ ID NO: 33584 - protein, 2072 aa, Homo sapiens
MIDHRLTDREWAEEWKHLDHLLNCIMDMVEKTRRSLTVLRRCQEADREELNYWIRRYSDAEDLKKGGGSSSSHSRQQSPVNPDPVALDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVAL

SEQ ID NO: 33585 - protein, 1868 aa, Homo sapiens
GLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSEANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSEANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSEANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSEANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSEANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSE

SEQ ID NO: 33586 - protein, 89 aa, Homo sapiens
MALTESLCTQNIQASDHALLAQASGTVQITAYPTSPMACLTLPHLHLSITVWMIWPLPTTTGTPIDTPATGTSGTETDLWGCMAHVKKK

SEQ ID NO: 33587 - protein, 10 aa, Homo sapiens
GGVKKQTGKN

SEQ ID NO: 33588 - protein, 12 aa, Homo sapiens
ITGSGGTVTPRT

SEQ ID NO: 33589 - protein, 1977 aa, Homo sapiens
MPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVAL

SEQ ID NO: 33590 - protein, 29 aa, Homo sapiens
TRIGNSFTGLRLDTCQRRSGRKLRRPSMR

SEQ ID NO: 33591 - protein, 35 aa, Homo sapiens
AAESRQPRPSCTRRASGIPSQACVWIRARGDLEES

SEQ ID NO: 33592 - protein, 9 aa, Homo sapiens
ALETVLSGF

SEQ ID NO: 33593 - protein, 13 aa, Homo sapiens
KHFFPVFSYTSWF

SEQ ID NO: 33594 - protein, 52 aa, Homo sapiens
VAFKYLHRGNPKVCFKSLKSNIFKSISSLYFHIQVGFNFVWVVLFFLNDFLV

SEQ ID NO: 33595 - protein, 230 aa, Homo sapiens
TKTGRGELQTDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRSY

SEQ ID NO: 33596 - protein, 37 aa, Homo sapiens
MIWPLPTTTGTPIDTPATGTSGTETDLWGCMAHVKKK

SEQ ID NO: 33597 - protein, 101 aa, Homo sapiens
TGRGELQTEPKKMALTESLCTQNIQASDHALLAQASGTVQITAYPTSPMACLTLPHLHLSITVWMIWPLPTTTGTPIDTPATGTSGTETDLWGCMAHVKKK

SEQ ID NO: 33598 - protein, 31 aa, Homo sapiens
GCVDNQSLQGWEDTSPNTYTPGISLKSKTIH

SEQ ID NO: 33599 - protein, 96 aa, Homo sapiens
LCRQPKFTRLGRHFSKYIYTRHFFKIKNNPLALGRGVGGGLNVGLGNSFKWLLSICIEAILRFALSLLNLTFLKAFLPCIFIYKLVLILFGWCYFF

SEQ ID NO: 33600 - protein, 17 aa, Homo sapiens
KSNLLTFFEVKHSMNVS

SEQ ID NO: 33601 - protein, 391 aa, Homo sapiens
MLVCYSVLACEILWDLPCSIMGSPLGHFTWDKYLKETCSVPAPVHCFKQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVIDWSDVRKHKYGHLSESASQYQEAADILDLGL

SEQ ID NO: 33602 - protein, 12 aa, Homo sapiens
MGVCYSHLLDFG

SEQ ID NO: 33603 - protein, 19 aa, Homo sapiens
MIRETTQGCHDHIFTSILH

SEQ ID NO: 33604 - protein, 53 aa, Homo sapiens
KLWTGRTLISFAQPLLGRFGAQRCLSLLMGGEGPLTTGAASTPETSSLWAGVP

SEQ ID NO: 33605 - protein, 220 aa, Homo sapiens
MKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKVLHTSKQRVQDQYEIGSTGPQEHHIHLYCHSSWTDRCPPSPAP

SEQ ID NO: 33606 - protein, 25 aa, Homo sapiens
MLENTNMVTYQSLHPNIKKLLTSWI

SEQ ID NO: 33607 - protein, 9 aa, Homo sapiens
MRLLGPCSF

SEQ ID NO: 33608 - protein, 55 aa, Homo sapiens
MFSPSACPLLQAVLHTSKQRVQDQYEIGSTGPQEHHIHLYCHSSWTDRCPPSPAP

SEQ ID NO: 33609 - protein, 24 aa, Homo sapiens
MAQRGSVLLHYRGNFKKCWFATVF

SEQ ID NO: 33610 - protein, 366 aa, Homo sapiens
MLPPSPAQPCRPQQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVLHTSKQRVQDQYEIGSTGPQEHHIHLYCHSSWTDRCPPSPAP

SEQ ID NO: 33611 - protein, 12 aa, Homo sapiens
LETTCSLLAPKL

SEQ ID NO: 33612 - protein, 36 aa, Homo sapiens
ILRSPASTAAPKLSWNINQGRGGVNQERSGAGHPRP

SEQ ID NO: 33613 - protein, 21 aa, Homo sapiens
LYRLCLSPENRLQLPQARPWW

SEQ ID NO: 33614 - protein, 1595 aa, Homo sapiens
MDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSR

SEQ ID NO: 33615 - protein, 1705 aa, Homo sapiens
ACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSR

SEQ ID NO: 33616 - protein, 38 aa, Homo sapiens
MGATTKMTSGGWLTQLKSSLLGTVKRMGVCYSHLLDFG

SEQ ID NO: 33617 - protein, 67 aa, Homo sapiens
MGATTKMTSGGWLTQLKSSLLGTVKRMGVCYSHLLHLVLFAWPKGALCCSTTEETSRNAGLLQCFSL

SEQ ID NO: 33618 - protein, 26 aa, Homo sapiens
MEQRWLPSGFSTRSHHRLPTTSSKWE

SEQ ID NO: 33619 - protein, 1218 aa, Homo sapiens
ARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKGHFTWDKYLKETCSVPAPVHCFKQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKGHFTWDKYLKETCSVPAPVHCFKQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKGHFTWDKYLKETCSVPAPVHCFKQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKGHFTWDKYLKETCSVPAPVHCFKQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTKGHFTWDKYLKETCSVPAPVHCFKQSYTPPSNEFKISMKLEAQDPRNTTSTCIATVVGLTGARLRLRLDGSDNKNDFWRLVDSAEIQPIGNCEKNGGMLQPPLGFRLNASSWPMFLLKTLNGAEMAPIRIFHKEPPSPSHNFFKMGMKLEAVDRKNPHFICPATIGEVRGSEVLVTFDGWRGAFDYWCRFDSRDIFPVGWCSLTGDNLQPPGTK

SEQ ID NO: 33620 - protein, 28 aa, Homo sapiens
AAPKLSWNINQGRGGVNQERSGAGHPRP

SEQ ID NO: 33621 - protein, 1729 aa, Homo sapiens
KKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSRVVIPKNPYPASDVNTEKPSIHSSTKTVLEHQPGQRGRKPGKKRGRTPKTLISHPISAPSKTAEPLKFPKKRGPKPGSKRKPRTLLNPPPASPTTSTPEPDTSTVPQDAATIPSSAMQAPTVCIYLNKNGSTGPHLDKKKVQQLPDHFGPARASVVLQQAVQACIDCAYHQKTVFSFLKQGHGGEVISAVFDREQHTLNLPAVNSITYVLRFLEKLCHNLRSDNLFGNQPFTQTHLSLTAIEYSHSHDRYLPGETFVLGNSLARSLEPHSDSMDSASNPTNLVSTSQRHRPLLSSCGLPPSTASAVRRLCSR

SEQ ID NO: 33622 - protein, 30 aa, Homo sapiens
QSVWQPALYTDSLVTHCHRVQPQPRQVPTR

SEQ ID NO: 33623 - protein, 1043 aa, Homo sapiens
MMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWL

SEQ ID NO: 33624 - protein, 1119 aa, Homo sapiens
LVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWL

SEQ ID NO: 33625 - protein, 933 aa, Homo sapiens
MFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWLVYAPVGIMFLVAGKIVEMEDVGLLFARLGKYILCCLLGHAIHGLLVLPLIYFLFTRKNPYRFLWGIVTPLATAFGTSSSSATLPLMMKCVEENNGVAKHISRFILPIGATVNMDGAALFQCVAAVFIAQLSQQSLDFVKIITILVTATASSVGAAGIPAGGVLTLAIILEAVNLPVDHISLILAVDWL

SEQ ID NO: 33626 - protein, 18 aa, Homo sapiens
MLWSFGCKLAWMGSRFGT

SEQ ID NO: 33627 - protein, 73 aa, Homo sapiens
RALCWVQFTRTRRMMSLRLTCCRSTPILAPRKILTVSCNRLKKRASVSFWTLLPTTGVRTRGSPLRLTLWPPR

SEQ ID NO: 33628 - protein, 19 aa, Homo sapiens
RMLWSFGCKLAWMGSRFGT

SEQ ID NO: 33629 - protein, 367 aa, Homo sapiens
IKVAEDEAEAAAAAKFTGLSKEELLKVAGSPGWVRTRWALLLLFWLGWLGMLAGAVVIIVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKAP

SEQ ID NO: 33630 - protein, 32 aa, Homo sapiens
RWQAAPAGYAPAGHCCCSSGSAGSACLLVPWS

SEQ ID NO: 33631 - protein, 13 aa, Homo sapiens
QGGGRRGGGGSRG

SEQ ID NO: 33632 - protein, 309 aa, Homo sapiens
IVRAPRCRELPAQKWWHTGALYRIGDLQAFQGHGAGNLAGLKGRLDYLSSLKVKGLVLGPIHKNQKDDVAQTDLLQIDPNFGSKEDFDSLLQSAKKKSIRVILDLTPNYRGENSWFSTQVDTVATKVKDALEFWLQAGVDGFQVRDIENLKDASSFLAEWQNITKGFSEDRLLIAGTNSSDLQQILSLLESNKDLLLTSSYLSDSGSTGEHTKSLVTQYLNATGNRWCSWSLSQARLLTSFLPAQLLRLYQLMLFTLPGTPVFSYGDEIGLDAAALPGQPMEAPVMLWDESSFPDIPGAVSANMTVKAP

SEQ ID NO: 33633 - protein, 153 aa, Homo sapiens
MRRLMAEDEEGYRKLIDQKKDKRLAYLLQQTDEYVANLTELVRQHKAAQVAKEKKKKKKKKKAENAEGQTPAIGPDGEPLDETSQMSDLPVKVIHVESGKILTGTDAPKAGQLEAWLEMNPGYEVAPRSDSEESGSEEEEEAAGSHRTPNSGT

SEQ ID NO: 33634 - protein, 21 aa, Homo sapiens
MQKDRRLPLGRMASLWTRPAR

SEQ ID NO: 33635 - protein, 64 aa, Homo sapiens
MPSKMSMMNMACPRPLHVACSPTMPWPMLSLREWTSSQRLWSMVSSNSTRSKVWSGWCPCTTTT

SEQ ID NO: 33636 - protein, 104 aa, Homo sapiens
TASWPTRWAWGRPSRPSRSSRTSWSTNASMGPSSSSCLSRMPSKMSMMNMACPRPLHVACSPTMPWPMLSLREWTSSQRLWSMVSSNSTRSKVWSGWCPCTTTT

SEQ ID NO: 33637 - protein, 22 aa, Homo sapiens
MVSSNSTRSKVWSGWCPCTTTT

SEQ ID NO: 33638 - protein, 548 aa, Homo sapiens
MGLGKTIQTIALITYLMEHKRINGPFLIIVPLSTLSNWAYEFDKWAPSVVKVSYKGSPAARRAFVPQLRSGKFNVLLTTYEYIIKDKHILAKIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAK

SEQ ID NO: 33639 - protein, 634 aa, Homo sapiens
IVPLSTLSNWAYEFDKWAPSVVKVSYKGSPAARRAFVPQLRSGKFNVLLTTYEYIIKDKHILAKIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAKIKGLEWLVSLYNNNLNGILADEMGLGKTIQTIALITYLMEHKRINGPFLIIVPLSTLSNWAYEFDKWAPSVVKVSYKGSPAARRAFVPQLRSGKFNVLLTTYEYIIKDKHILAK

SEQ ID NO: 33640 - protein, 26 aa, Homo sapiens
RCLTRDPQQQDGPLSPSSGVGSSTSC

SEQ ID NO: 33641 - protein, 113 aa, Homo sapiens
QVGPLRGEGVLQGIPSSKTGLCPPAPEWEVQRLADDVRVHHQRQAHPRQDQRFGVAGVPVQQQPERHPGRRDGPGEDHPDHRAHHVPHGAQTHQWALPHHRASLNAVQLGVRV

SEQ ID NO: 33642 - protein, 9 aa, Homo sapiens
QCTDTQTPA

SEQ ID NO: 33643 - protein, 21 aa, Homo sapiens
MSSGSGNTYWNCSGPGDSGSR

SEQ ID NO: 33644 - protein, 901 aa, Homo sapiens
MPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRSRISVWKLKTTKRRNLPRMHCCCGAR

SEQ ID NO: 33645 - protein, 8 aa, Homo sapiens
APGGEAHL

SEQ ID NO: 33646 - protein, 14 aa, Homo sapiens
AHKTGETGTARPQI

SEQ ID NO: 33647 - protein, 9 aa, Homo sapiens
GRHKKARGH

SEQ ID NO: 33648 - protein, 28 aa, Homo sapiens
MANTYLVWKTCYRSTPWLKQTLASRQSG

SEQ ID NO: 33649 - protein, 28 aa, Homo sapiens
ASQRGRTMSSGSGNTYWNCSGPGDSGSR

SEQ ID NO: 33650 - protein, 669 aa, Homo sapiens
AHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRSRISVWKLKTTKRRNLPRMHCCCGAR

SEQ ID NO: 33651 - protein, 1027 aa, Homo sapiens
MRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33652 - protein, 68 aa, Homo sapiens
MLMTLMPGCWTSSRLSPAATWATMSIPHSLWSRNTRTWRKRSPITGPPLTRCTNKPAPSPRSMPSLQT

SEQ ID NO: 33653 - protein, 21 aa, Homo sapiens
AGHQGRRRHDRGGALRVGEDP

SEQ ID NO: 33654 - protein, 23 aa, Homo sapiens
AALGHSEEAPGGGLPAAPVPGRC

SEQ ID NO: 33655 - protein, 32 aa, Homo sapiens
TWRKRSPITGPPLTRCTNKPAPSPRSMPSLQT

SEQ ID NO: 33656 - protein, 847 aa, Homo sapiens
MFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33657 - protein, 48 aa, Homo sapiens
RTLWPCTRCSARLMPVSSGSTRRSSGSTTCRSQRSWRIWRSSSTDLRA

SEQ ID NO: 33658 - protein, 29 aa, Homo sapiens
ALDRREGAVAQQHADPREAGGSGGHPAQI

SEQ ID NO: 33659 - protein, 785 aa, Homo sapiens
MHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33660 - protein, 33 aa, Homo sapiens
MKPNPGFGKRPRSSSPPRTWAMTWLASWPCSAS

SEQ ID NO: 33661 - protein, 42 aa, Homo sapiens
ASRTTTSSAMKPNPGFGKRPRSSSPPRTWAMTWLASWPCSAS

SEQ ID NO: 33662 - protein, 34 aa, Homo sapiens
VTCRRRRRSWSPSTPTRPRPSCLGWPRSATCGRR

SEQ ID NO: 33663 - protein, 654 aa, Homo sapiens
MKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33664 - protein, 611 aa, Homo sapiens
MPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33665 - protein, 563 aa, Homo sapiens
MFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33666 - protein, 9 aa, Homo sapiens
QPGVCSGSH

SEQ ID NO: 33667 - protein, 504 aa, Homo sapiens
MPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33668 - protein, 30 aa, Homo sapiens
MWRTRSCGLERGCLWQLPRIMATTSRLCSC

SEQ ID NO: 33669 - protein, 48 aa, Homo sapiens
TRGSITCWPPKRSISSTGMWRTRSCGLERGCLWQLPRIMATTSRLCSC

SEQ ID NO: 33670 - protein, 93 aa, Homo sapiens
MSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33671 - protein, 28 aa, Homo sapiens
TTSLRGAKTSSLTAAASALRPSDRGLPT

SEQ ID NO: 33672 - protein, 17 aa, Homo sapiens
GHQTEACRPEAAVGSPH

SEQ ID NO: 33673 - protein, 13 aa, Homo sapiens
AHQLWTFRCRHHR

SEQ ID NO: 33674 - protein, 1559 aa, Homo sapiens
MVRDLMLWMEDVIRQIEAQEKPRDVSSVELLMNNHQGIKAEIDARNDSFTTCIELGKSLLARKHYASEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEERRGKLDERHRLFQLNREVDDLEQWIAEREVVAGSHELGQDYEHVTMLQERFREFARDTGNIGQERVDTVNHLADELINSGHSDAATIAEWKDGLNEAWADLLELIDTRTQILAASYELHKFYHDAKEIFGRIQDKHKKLPEELGRDQNTVETLQRMHTTFEHDIQALGTQVRQLQEDAARLQAAYAGDKADDIQKRENEVLEAWKSLLDACESRRVRLVDTGDKFRFFSMVRDLMLWMEDVIRQIEAQEKPRDVSSVELLMNNHQGIKAEIDARNDSFTTCIELGKSLLARKHYASEE

SEQ ID NO: 33675 - protein, 28 aa, Homo sapiens
LGEIRTQWRPYRECTLHLSMTSRLWAHR

SEQ ID NO: 33676 - protein, 88 aa, Homo sapiens
GSCRRMQPASRRPMRVTRPTISRSARTRSWKPGSPSWTPVRAAGCGWWTQGTSSASSAWCATSCSGWRMSSGRSRPRRSQGMYHLLNS

SEQ ID NO: 33677 - protein, 23 aa, Homo sapiens
QGRRYPEARERGPGSLEVPPGRL

SEQ ID NO: 33678 - protein, 933 aa, Homo sapiens
VEKPPKFTEKGNLEVLLFTIQSKMRANNQKVYMPREGKLISDINKAWERLEKAEHERELALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRSRISVWKLKTTKRRNLPRMHCCCGAR

SEQ ID NO: 33679 - protein, 875 aa, Homo sapiens
LALRNELIRQEKLEQLARRFDRKAAMRETWLSENQRLVSQDNFGFDLPAVEAATKKHEAIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRSRISVWKLKTTKRRNLPRMHCCCGAR

SEQ ID NO: 33680 - protein, 1175 aa, Homo sapiens
MNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33681 - protein, 1235 aa, Homo sapiens
AIETDIAAYEERVQAVVAVARELEAENYHDIKRITARKDNVIRLWEYLLELLRARRQRLEMNLGLQKIFQEMLYIMDWMDEMKVLVLSQDYGKHLLGVEDLLQKHTLVEADIGIQAERVRGVNASAQKFATDGEGYKPCDPQVIRDRVAHMEFCYQELCQLAAERRARLEESRRLWKFFWEMAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33682 - protein, 636 aa, Homo sapiens
MAEEEGWIREKEKILSSDDYGKDLTSVMRLLSKHRAFEDEMSGRSGHFEQAIKEGEDMIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRSRISVWKLKTTKRRNLPRMHCCCGAR

SEQ ID NO: 33683 - protein, 579 aa, Homo sapiens
MIAEEHFGSEKIRERIIYIREQWANLEQLSAIRKKRLEEASLLHQFQADADDIDAWMLDILKIVSSSDVGHDEYSTQSLVKKHKDVAEEIANYRPTLDTLHEQASALPQEHAESPDVRGRLSGIEERYKEVAELTRLRKQALQDTLALYKMFSEADACELWIDEKEQWLNNMQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRSRISVWKLKTTKRRNLPRMHCCCGAR

SEQ ID NO: 33684 - protein, 18 aa, Homo sapiens
ACRVSRREGQAVGHRGAV

SEQ ID NO: 33685 - protein, 826 aa, Homo sapiens
MQIPEKLEDLEVIQHRFESLEPEMNNQASRVAVVNQIARQLMHSGHPSEKEIKAQQDKLNTRWSQFRELVDRKKDALLSALSIQNYHLECNETKSWIREKTKVIESTQDLGNDLAGVMALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33686 - protein, 15 aa, Homo sapiens
AGQTQHKVEPVQRTG

SEQ ID NO: 33687 - protein, 25 aa, Homo sapiens
RTNSTQGGASSENWLTGRRMPSCLP

SEQ ID NO: 33688 - protein, 709 aa, Homo sapiens
MALQRKLTGMERDLVAIEAKLSDLQKEAEKLESEHPDQAQAILSRLAEISDVWEEMKTTLKNREASLGEASKLQQFLRDLDDFQSWLSRTQTAIASEDMPNTLTEAEKLLTQHENIKNEIDNYEEDYQKMRDMGEMVTQGQTDAQYMFLRQRLQALDTGWNELHKMWENRQNLLSQSHAYQQFLRDTKQAEAFLNNQEYVLAHTEMPTTLEGAEAAIKKQEDFMTTMDANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33689 - protein, 22 aa, Homo sapiens
MRRCSQPRTCLTMKPEICTVNG

SEQ ID NO: 33690 - protein, 481 aa, Homo sapiens
ANEEKINAVVETGRRLVSDGNINSDRIQEKVDSIDDRHRKNRETASELLMRLKDNRDLQKFLQDCQELSLWINEKMLTAQDMSYDEARNLHSKWLKHQAFMAELASNKEWLDKIEKEGMQLISEKPETEAVVKEKLTGLHKMWEVLESTTQTKAQRLFDANKAELFTQSCADLDKWLHGLESQIQSDDYGKDLTSVNILLKKQQMLENQMEVRKKEIEELQSQAQALSQEGKSTDEVDSKRLTVQTKFMELLEPLNERKHNLLASKEIHQFNRDVEDEILWVGERMPLATSTDHGHNLQTVQLLIKKNQTLQKEIQGHQPRIDDIFERSQNIVTDSSSLSAEAIRQRLADLKQLWGLLIEETEKRHRRLEEAHRAQQYYFDAAEAEAWMSEQELYMMSEEKAKDEQSAVSMLKKHQILEQAVEDYAETVHQLSKTSRALVADSHPERTTLGLTFLQLRPPQKSTRPLRQTLPHTRSVCRLW

SEQ ID NO: 33691 - protein, 42 aa, Homo sapiens
RTTGIYRNSCKIVKSCLSGSMRRCSQPRTCLTMKPEICTVNG

SEQ ID NO: 33692 - protein, 11 aa, Homo sapiens
MAARPGESDSV

SEQ ID NO: 33693 - protein, 11 aa, Homo sapiens
IHYPDKGPAAL

SEQ ID NO: 33694 - protein, 15 aa, Homo sapiens
KECSSFQKSLRRKLW

SEQ ID NO: 33695 - protein, 40 aa, Homo sapiens
RRNSLVYIKCGKSLNPLPRQRPSGSLMQTRPNFSPRAVQI

SEQ ID NO: 33696 - protein, 26 aa, Homo sapiens
MRLSGATTSLNRWVRMAGVMSQLPSR

SEQ ID NO: 33697 - protein, 68 aa, Homo sapiens
ARRNLSPPLQRLRDWGHHHCPCHPGPGWLSTDREHPAILCQRPVHSLTGGPNPGSCSAQKSLSQEAQG

SEQ ID NO: 33698 - protein, 105 aa, Homo sapiens
MTVERDQPLPTPELQMPTMVPSYDLGMAPDSSMSMQLGPDMVPQVYPPHSHSIPPYQGLSPEESVNVLSAFQERSCWAVASPFGSGLMVSWTSPNAVSGATGLTG

SEQ ID NO: 33699 - protein, 8 aa, Homo sapiens
GFPEPLQA

SEQ ID NO: 33700 - protein, 164 aa, Homo sapiens
IQPFSAKDLSIRSLGDRIRDLAQLKNLYPKKPKDEAFRSHYKPEQMGKDGRGYVPATIKMTVERDQPLPTPELQMPTMVPSYDLGMAPDSSMSMQLGPDMVPQVYPPHSHSIPPYQGLSPEESVNVLSAFQERSCWAVASPFGSGLMVSWTSPNAVSGATGLTG

SEQ ID NO: 33701 - protein, 18 aa, Homo sapiens
MVSWTSPNAVSGATGLTG

SEQ ID NO: 33702 - protein, 53 aa, Homo sapiens
ACSLAQIWCPRCTHHTLTPSPRIKASPQKNQSTCCQPSRRDPAGPWLHLLAVV

SEQ ID NO: 33703 - protein, 38 aa, Homo sapiens
MEPWWGCMLLAGRLHSRTCRRTPRLGHSCLTLFMWSVG

SEQ ID NO: 33704 - protein, 24 aa, Homo sapiens
MTTGLCGMGLPSCSATSSGLMGTL

SEQ ID NO: 33705 - protein, 63 aa, Homo sapiens
VASISISCYPCRRSWQILCGRSAATMEPWWGCMLLAGRLHSRTCRRTPRLGHSCLTLFMWSVG

SEQ ID NO: 33706 - protein, 676 aa, Homo sapiens
MEIKFKDELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKDELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKDELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKDELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKDELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFK

SEQ ID NO: 33707 - protein, 48 aa, Homo sapiens
VAVEKRVQLRSRNQHSLSMSHLSAQWRYPGKHSRGDGNQIQRRTGCLP

SEQ ID NO: 33708 - protein, 742 aa, Homo sapiens
IAKQRYIGGKNLPTRGTAEWLSFDVTDTVREWLLRRESNLGLEISIHCPCHTFQPNGDILENIHEVMEIKFKDELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKDELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKDELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKDELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFKDELAVCPKGITSKVFRFNVSSVEKNRTNLFRAEFRVLRVPNPSSKRNEQRIELFQILRPDEHIAKQRYIGGKNLPTRGTAEWLSFDVTDTVREWLLRRESNLGLEISIHCPCHTFQPNGDILENIHEVMEIKFK

SEQ ID NO: 33709 - protein, 33 aa, Homo sapiens
LPNSAISVARICPHGALPSGCPLMSLTLCVSGC

SEQ ID NO: 33710 - protein, 505 aa, Homo sapiens
MTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKEKGPSMKEPNPISPPIFHGLDTLTVMGIAFAAFVIGALLTGALWYIYSHTGV

SEQ ID NO: 33711 - protein, 54 aa, Homo sapiens
IFPGESGMKREKMGSLGQRTLSFPAYNCFLVSESQKRCKGAWILPCLSNVTMRR

SEQ ID NO: 33712 - protein, 333 aa, Homo sapiens
MDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKGHTSPESHLLSPHPPQVCCVPAQLPTPPGVASEDRETCHWGLQTVFGV

SEQ ID NO: 33713 - protein, 27 aa, Homo sapiens
ALSLHIRTLIGCLITPLLRIFVLKMNL

SEQ ID NO: 33714 - protein, 17 aa, Homo sapiens
ICEILQSQESALSYPAS

SEQ ID NO: 33715 - protein, 98 aa, Homo sapiens
MEKHPQKLPKCVPPDEACTSLDASIIWAMMQNKKTFTKPLAVIHHEAESKGHTSPESHLLSPHPPQVCCVPAQLPTPPGVASEDRETCHWGLQTVFGV

SEQ ID NO: 33716 - protein, 11 aa, Homo sapiens
MKQNLKKKVQA

SEQ ID NO: 33717 - protein, 15 aa, Homo sapiens
ADAVYEDGEAPPEVA

SEQ ID NO: 33718 - protein, 734 aa, Homo sapiens
MKQNLKVTLHLNPISSVHIHHKSVVFLLNSPHPLVWHLKTERLATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKGHTSPESHLLSPHPPQVCCVPAQLPTPPGVASEDRETCHWGLQTVFGV

SEQ ID NO: 33719 - protein, 60 aa, Homo sapiens
IHHEAESKEKGPSMKEPNPISPPIFHGLDTLTVMGIAFAAFVIGALLTGALWYIYSHTGV

SEQ ID NO: 33720 - protein, 16 aa, Homo sapiens
RNQIQFLHQFSMVWTP

SEQ ID NO: 33721 - protein, 588 aa, Homo sapiens
MSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKGHTSPESHLLSPHPPQVCCVPAQLPTPPGVASEDRETCHWGLQTVFGV

SEQ ID NO: 33722 - protein, 25 aa, Homo sapiens
LPLGSPDCFWCLRVLWSSFHQQTSP

SEQ ID NO: 33723 - protein, 17 aa, Homo sapiens
IGPEKSMEQLLHSPNSR

SEQ ID NO: 33724 - protein, 691 aa, Homo sapiens
ATGVSRLFLVSEGSVVQFSSANFSLTAETEERNFPHGNEHLLNWARKEYGAVTSFTELKIARNIYIKVGEDQVFPPKCNIGKNFLSLNYLAEYLQPKAAEGCVMSSQPQNEEVHIIELITPNSNPYSAFQVDITIDIRPSQEDLEVVKNLILILKCKKSVNWVIKSFDVKGSLKIIAPNSIGFGKESERSMTMTKSIRDDIPSTQGNLVKWALDNGYSPITSYTMAPVANRFHLRLENNAEEMGDEEVHTIPPELRILLDPGALPALQNPPIRGGEGQNGGLPFPFPDISRRVWNEEGEDGLPRPKDPVIPSIQLFPGLREPEEVQGSVDIALSVKCDNEKMIVAVEKDSFQASGYSGMDVTLLDPTCKAKMNGTHFVLESPLNGCGTRPRWSALDGVVYYNSIVIQVPALGDSSGWPDGYEDLESGDNGFPGDMDEGDASLFTRPEIVVFNCSLQQVRNPSSFQEQPHGNITFNMELYNTDLFLVPSQGVFSVPENGHVYVEVSVTKAEQELGFAIQTCFISPYSNPDRMSHYTIIENICPKDESVKFYSPKRVHFPIPQADMDKKRFSFVFKPVFNTSLLFLQCELTLCTKMEKHPQKLPKCVPPDEACTSLDASIIWAMMQNKKTFTKPLAVIHHEAESKGHTSPESHLLSPHPPQVCCVPAQLPTPPGVASEDRETCHWGLQTVFGV

SEQ ID NO: 33725 - protein, 1125 aa, Homo sapiens
MCNSSCMGGMNRRPILTIITLEDSSGNLLGRNSFEVRVCACPGRDRRTEEENLRKKGEPHHELPPGSTKRALPNNTSSSPQPKKKPLDGEYFTLQYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQYSPALNKMFCQLAKTCPVQLWVDSTPPPGTRVRAMAIYKQSQHMTEVVRRCPHHERCSDSDGLAPPQHLIRVEGNLRVEYLDDRNTFRHSVVVPYEPPEVGSDCTTIHYNYMCNSSCMGGMNRRPILTIITLEDSSGNLLGRNSFEVRVCACPGRDRRTEEENLRKKGEPHHELPPGSTKRALPNNTSSSPQPKKKPLDGEYFTLQ

SEQ ID NO: 33726 - protein, 72 aa, Homo sapiens
GAAPTMSAAQIAMVWPLLSILSEWKEICVWSIWMTETLFDIVWWCPMSRLRLALTVPPSTTTTCVTVPAWAA

SEQ ID NO: 33727 - protein, 21 aa, Homo sapiens
LALTVPPSTTTTCVTVPAWAA

SEQ ID NO: 33728 - protein, 51 aa, Homo sapiens
MENISPFSTPLPSTRCFANWPRPALCSCGLIPHPRPAPASAPWPSTSSHST

SEQ ID NO: 33729 - protein, 10 aa, Homo sapiens
LYHHPLQLHV

SEQ ID NO: 33730 - protein, 60 aa, Homo sapiens
MVWPLLSILSEWKEICVWSIWMTETLFDIVWWCPMSRLRLALTVPPSTTTTCVTVPAWAA

SEQ ID NO: 33731 - protein, 179 aa, Homo sapiens
MRPTSHMKTSRPPSTQAPCSTPSGSPCSRTSTQSSTKSLRTTIGEAFERLHRLLRERQKAMLEELEADTARTLTDIEQKVQRYSQQLRKVQEGAQILQERLAETDRHTFLAGVASLSERLKGKIHETNLTYEDFPTSKYTGPLQYTIWKSLFQDIHPVFHQEPADHYRRGLRAAAPAAA

SEQ ID NO: 33732 - protein, 10 aa, Homo sapiens
RSWRRTRPAR

SEQ ID NO: 33733 - protein, 43 aa, Homo sapiens
GHARGAGGGHGPHADRHRAESPALQPAAAQGPGGSPDPAGAAG

SEQ ID NO: 33734 - protein, 120 aa, Homo sapiens
AMLEELEADTARTLTDIEQKVQRYSQQLRKVQEGAQILQERLAETDRHTFLAGVASLSERLKGKIHETNLTYEDFPTSKYTGPLQYTIWKSLFQDIHPVFHQEPADHYRRGLRAAAPAAA

SEQ ID NO: 33735 - protein, 87 aa, Homo sapiens
MLEELEADTARTLTDIEQKVQRYSQQLRKVQEGAQILQERLAETDRHTFLAGVASLSERLPPRACGPLSARPSSGCTGCCVNARRPC

SEQ ID NO: 33736 - protein, 115 aa, Homo sapiens
MKRLEKYLSQMKNRPMCLTSMPLAIYWRIRWSSPQLQSRQEDCWLRGSMQVPLSSVTMKMFQPLYLLLWNMVLVAFLRRKLWRSLGKKILRFTIVTFGHWNGRFRQEITTNVMQK

SEQ ID NO: 33737 - protein, 221 aa, Homo sapiens
MKIKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEN

SEQ ID NO: 33738 - protein, 1868 aa, Homo sapiens
MNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVK

SEQ ID NO: 33739 - protein, 149 aa, Homo sapiens
VKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNRTVGPWKERSRNWPRKPICPLCL

SEQ ID NO: 33740 - protein, 36 aa, Homo sapiens
MWTDQKAAGQHNWNPPCLCRGLSGGQTSKATKNERP

SEQ ID NO: 33741 - protein, 9 aa, Homo sapiens
QQMLCKNNL

SEQ ID NO: 33742 - protein, 60 aa, Homo sapiens
TCCGLSRTGSKCWRSYTRLCSCAQMWTDQKAAGQHNWNPPCLCRGLSGGQTSKATKNERP

SEQ ID NO: 33743 - protein, 2533 aa, Homo sapiens
AVEKFGEENIEVYHSYFWPLEWTIPSRDNNKCYAKIICNTKDNERVVGFHVLGPNAGEVTQGFAAALKCGLTKKQLDSTIGIHPVCAEAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAEAYQEGRLQKLLKMNGPEDLPKSYDYDLIIIGGGSGGLAAAKEAAQYGKKVMVLDFVTPTPLGTRWGLGGTCVNVGCIPKKLMHQAALLGQALQDSRNYGWKVEETVKHDWDRMIEAVQNHIGSLNWGYRVALREKKVVYENAYGQFIGPHRIKATNNKGKEKIYSAERFLIATGERPRYLGIPGDKEYCISSDDLFSLPYCPGKTLVVGASYVALECAGFLAGIGLDVTVMVRSILLRGFDQDMANKIGEHMEEHGIKFIRQFVPIKVEQIEAGTPGRLRVVAQSTNSEEIIEGEYNTVMLAIGRDACTRKIGLETVGVKINEKTGKIPVTDEEQTNVPYIYAIGDILEDKVELTPVAIQAGRLLAQRLYAGSTVKCDYENVPTTVFTPLEYGACGLSEEKAVEKFGEENIEVYHSYFWPLEWTIPSRDNNKCYAKIICNTKDNERVVGFHVLGPNAGEVTQGFAAALKCGLTKKQLDSTIGIHPVCAE

SEQ ID NO: 33744 - protein, 35 aa, Homo sapiens
LWRSLGKKILRFTIVTFGHWNGRFRQEITTNVMQK

SEQ ID NO: 33745 - protein, 11 aa, Homo sapiens
MLNGIQGANIC

SEQ ID NO: 33746 - protein, 23 aa, Homo sapiens
LIGSPVKTLGNNMLNGIQGANIC

SEQ ID NO: 33747 - protein, 26 aa, Homo sapiens
MVSRVQISVRTEGTRIYKQYSFNSFT

SEQ ID NO: 33748 - protein, 9 aa, Homo sapiens
GWTTFMALG

SEQ ID NO: 33749 - protein, 51 aa, Homo sapiens
ILWTGTSSRPMTDCSASSSTYRILPTSTMPPRSCWTGAETHGPSSGPSSRA

SEQ ID NO: 33750 - protein, 11 aa, Homo sapiens
AGQRSWLSGRT

SEQ ID NO: 33751 - protein, 116 aa, Homo sapiens
LDNVHGSRVEPSETARMNSMDRHIQQTNDRLQCIKQHLQNPANFHNAATELLDWCGDPRAFQRPFEQSLMGCLTVVSRVAAQQGFDLDLGYRLLAVCAANRDKFTPKSAGLTAAVF

SEQ ID NO: 33752 - protein, 66 aa, Homo sapiens
MGCLTVVSRVAAQQGFDLDLGYRLLAVCAANRDKFTPKSAAGWSWSEVEGPQAADRRVEHWWFADH

SEQ ID NO: 33753 - protein, 135 aa, Homo sapiens
LDNVHGSRVEPSETARMNSMDRHIQQTNDRLQCIKQHLQNPANFHNAATELLDWCGDPRAFQRPFEQSLMGCLTVVSRVAAQQGFDLDLGYRLLAVCAANRDKFTPKSAAGWSWSEVEGPQAADRRVEHWWFADH

SEQ ID NO: 33754 - protein, 1870 aa, Homo sapiens
MQGDARRRRNENYFDDIPRSKLERQMAQQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVVLKINLIGHRKRILASLGDRLHDDPPQKPPRSITLREPSGNHTPPQLSPSLSQSTYTTGGSLDVPHIIMQGDARRRRNENYFDDIPRSKLERQMAQQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVVLKINLIGHRKRILASLGDRLHDDPPQKPPRSITLREPSGNHTPPQLSPSLSQSTYTTGGSLDVPHIIMQGDARRRRNENYFDDIPRSKLERQMAQQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVVLKINLIGHRKRILASLGDRLHDDPPQKPPRSITLREPSGNHTPPQLSPSLSQSTYTTGGSLDVPHIIMQGDARRRRNENYFDDIPRSKLERQMAQQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVVLKINLIGHRKRILASLGDRLHDDPPQKPPRSITLREPSGNHTPPQLSPSLSQSTYTTGGSLDVPHIIMQGDARRRRNENYFDDIPRSKLERQMAQQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSVVLKINLIGHRKRILASLGDRLHDDPPQKPPRSITLREPSGNHTPPQLSPSLSQSTYTTGGSLDVPHIIMQGDARRRRNENYFDDIPRSKLERQMAQQSSVCEIWTNQNAGFPFSAIHQVHNTGDWGEPSITLRPPNEATASTPVQYWQHHPEKLIFQSCDYKAFYLGSMLIKELRGTESTQDACAKMRANCQKSTEQMKKVPTIILSVSYKGVKFIDATNKNIIAEHEIRNISCAAQDPEDLSTFAYITKDLKSNHHYCHVFTAFDVNLAYEIILTLGQAFEVAYQLALQARKGGHSSTLPESFENKPSKPIPKPRVSIRKSV

SEQ ID NO: 33755 - protein, 29 aa, Homo sapiens
TYFGISGRQAARRSPTEAPSVHHPQGTQW

SEQ ID NO: 33756 - protein, 103 aa, Homo sapiens
TFLTLSCRAMQGGEEMKTTLMIFPDQNWRGRWLSSRLSVKYGRIRTQDFLSQRSIRFIIQETGENLPLPCDLRMKPQPLPRYSTGSITQKSLSSSRVITKLLF

SEQ ID NO: 33757 - protein, 558 aa, Homo sapiens
MEETKEAMSEMLRHPRISGKPILVKVTLLMVGLDNAGKTATAKGIQGEYPEDVAPTVGFSKINLRQGKFEVTIFDLGGGIRIRGIWKNYYAESYGVIFVVDSSDEERMEETKEAMSEMLRHPRISGKPILVKVTLLMVGLDNAGKTATAKGIQGEYPEDVAPTVGFSKINLRQGKFEVTIFDLGGGIRIRGIWKNYYAESYGVIFVVDSSDEERMEETKEAMSEMLRHPRISGKPILVKVTLLMVGLDNAGKTATAKGIQGEYPEDVAPTVGFSKINLRQGKFEVTIFDLGGGIRIRGIWKNYYAESYGVIFVVDSSDEERMEETKEAMSEMLRHPRISGKPILVKVTLLMVGLDNAGKTATAKGIQGEYPEDVAPTVGFSKINLRQGKFEVTIFDLGGGIRIRGIWKNYYAESYGVIFVVDSSDEERMEETKEAMSEMLRHPRISGKPILVKVTLLMVGLDNAGKTATAKGIQGEYPEDVAPTVGFSKINLRQGKFEVTIFDLGGGIRIRGIWKNYYAESYGVIFVVDSSDEERMEETKEAMSEMLRHPRISGKPIL

SEQ ID NO: 33758 - protein, 11 aa, Homo sapiens
ILWGNICCGFQ

SEQ ID NO: 33759 - protein, 32 aa, Homo sapiens
MEETKEAMSEMLRHPRISGKPILKGDSFDGGT

SEQ ID NO: 33760 - protein, 294 aa, Homo sapiens
MSEQGDLNQAIAEEGGTEQETATPENGIVKSESLDEEEKLELQRRLEAQNQERRKSKSGAGKGKLTRSLAVCEESSARPGGESLQDQESIHLQLSSFSSLQEEDKSRKDDSEREKEKDKNKDKTSEKPKIRMLSKDCSQEYTDSTGIDLHEFLINTLKNNSRDRMILLKMEQEIIDFIADNNNHYKKFPQMSSYQRMLVHRVAAYFGLDHNVDQTGKSVIINKTSSTRIPEQRFCEHLKDEKGEESQKRFILKRDNSSIDKEDNQVDDVSHCVRESHGDGHSELLMGTWDSSCL

SEQ ID NO: 33761 - protein, 328 aa, Homo sapiens
MSEQGDLNQAIAEEGGTEQETATPENGIVKSESLDEEEKLELQRRLEAQNQERRKSKSGAGKGKLTRSLAVCEESSARPGGESLQDQESIHLQLSSFSSLQEEDKSRKDDSEREKEKDKNKDKTSEKPKIRMLSKDCSQEYTDSTGIDLHEFLINTLKNNSRDRMILLKMEQEIIDFIADNNNHYKKFPQMSSYQRMLVHRVAAYFGLDHNVDQTGKSVIINKTSSTRIPEQRFCEHLKDEKGEESQKRFILKRDNSSIDKEDNQQNRMHPFRDDRRSKSIEEREEEYQRVRERIFAHDVDDVSHCVRESHGDGHSELLMGTWDSSCL

SEQ ID NO: 33762 - protein, 58 aa, Homo sapiens
MPFTLHLRSRLPSAIRSLILQKKPNIRNTSSMAGDGEGKASDLSRATLSKGDLSPQGC

SEQ ID NO: 33763 - protein, 29 aa, Homo sapiens
KLTSRWHSSSEQGKCNSGPMCDSETRPTN

SEQ ID NO: 33764 - protein, 34 aa, Homo sapiens
RSQVTPCLTLPSKGRLCKILCYLFKLTRCPSHST

SEQ ID NO: 33765 - protein, 35 aa, Homo sapiens
QAGGILLQSRASVILDQCVILRPDQPTEGAKLHPV

SEQ ID NO: 33766 - protein, 794 aa, Homo sapiens
MPVKTSKAYLTVLGVPEKPQISGFSSPVMEGDLMQLTCKTSGSKPAADIRWFKNDKEIKGSQGQFPLTQNVTVVEGGTAILTCRVDQNDNTSLQWSNPAQQTLYFDDKKALRDNRIELVRASWHELSISVSDVSLSDEGQYTCSLFTMPVKTSKAYLTVLGVPEKPQISGFSSPVMEGDLMQLTCKTSGSKPAADIRWFKNDKEIKGSQGQFPLTQNVTVVEGGTAILTCRVDQNDNTSLQWSNPAQQTLYFDDKKALRDNRIELVRASWHELSISVSDVSLSDEGQYTCSLFTMPVKTSKAYLTVLGVPEKPQISGFSSPVMEGDLMQLTCKTSGSKPAADIRWFKNDKEIKGSQGQFPLTQNVTVVEGGTAILTCRVDQNDNTSLQWSNPAQQTLYFDDKKALRDNRIELVRASWHELSISVSDVSLSDEGQYTCSLFTMPVKTSKAYLTVLGVPEKPQISGFSSPVMEGDLMQLTCKTSGSKPAADIRWFKNDKEIKGSQGQFPLTQNVTVVEGGTAILTCRVDQNDNTSLQWSNPAQQTLYFDDKKALRDNRIELVRASWHELSISVSDVSLSDEGQYTCSLFTMPVKTSKAYLTVLGVPEKPQISGFSSPVMEGDLMQLTCKTSGSKPAADIRWFKNDKEIKGSQGQFPLTQNVTVVEGGTAILTCRVDQNDNTSLQWSNPAQQTLYFDDKKALRDNRIELVRASWHELSISVSDVSLSDEGQYTCSLFTMPVKTSKAYLTVLGVPEKPQISGFSSPVMEGDLMQLTCKTSGSKPAADIRWFKNDKEIK

SEQ ID NO: 33767 - protein, 25 aa, Homo sapiens
RTVHLFFIYNACQNFQGISHRSGCS

SEQ ID NO: 33768 - protein, 34 aa, Homo sapiens
LGKTTNPKTASCLLPARSSGRTQLHLSPAGRTWT

SEQ ID NO: 33769 - protein, 48 aa, Homo sapiens
GTRDWERPRIQKQPAVCCQPEVQEEHSSISLQPEEHGPSEVRYQDPRA

SEQ ID NO: 33770 - protein, 225 aa, Homo sapiens
MDLAKSGIKILVPKSPVKSRTAVDGFQSESPEKLDPVEQGQEDTVAPEVAAEKPVGALLGPGAERARMGSRPRIHPLVPQVPGPVTAAMATGLAVNGKGTSPFMDALTANGTTNIQTSVTGVTASKRKFIDDRRDQPFDKRLRFSVRQTESAYRYRDIVVRKQDGFTHILLSTKSSENNSLNPEVMREVQSALSTAAADDSKLVLLSAVGSVFCCGLDFIYFIRR

SEQ ID NO: 33771 - protein, 37 aa, Homo sapiens
MRLMRKLNLPQVTWLLPLVTCQLTRSELLLLLCHREW

SEQ ID NO: 33772 - protein, 18 aa, Homo sapiens
IAFLVSPTLTFLLKWLSA

SEQ ID NO: 33773 - protein, 69 aa, Homo sapiens [sequence omitted]

SEQ ID NO: 33774 - protein, 11 aa, Homo sapiens
MLRTSANLSPM

SEQ ID NO: 33775 - protein, 135 aa, Homo sapiens
MSGSSARSSHLSQPVVKSVLVYRNGDPFYAGRRVVIHEKKVSSFEVFLKEVTGGVQAPFGAVRNIYTPRTGHRIRKLDQIQSGGNYVAGGQEAFKKLNYLDIGEIKKRPMEVVNTEACLFEGPARFRLLLRSCPP

SEQ ID NO: 33776 - protein, 15 aa, Homo sapiens
GRWDSGGASRREAAS

SEQ ID NO: 33777 - protein, 99 aa, Homo sapiens
MKNIMAGLQQTNSEKILLSWVRQSTRNYPQVNVINFTTSWSDGLALNALIHSHRPDLFDWNSVVCQQSATQRLEHAFNIARYQLGIEKLLDPEVWEAAY

SEQ ID NO: 33778 - protein, 8 aa, Homo sapiens
KDPQEFMP

SEQ ID NO: 33779 - protein, 21 aa, Homo sapiens
RIHKSSCPEQCQQGTAGFAEQ

SEQ ID NO: 33780 - protein, 869 aa, Homo sapiens
MAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEYILGTVHKAKGLEFDTVHVLDDFVKVPCARHNLPQLPHFRVESFSEDEWNLLYVAVTRAKKRLIMTKSLENILTLAG

SEQ ID NO: 33781 - protein, 927 aa, Homo sapiens
LARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLPCQEALSHICSLPSEVLRHVFAFLPVEDLYWNLSLVCHLWREIISDPLFIPWKKLYHRYLMNEEQAVSKVDGILSNCGIEKESDLCVLNLIRYTATTKCSPSVDPERVLWSLRDHPLLPEAEACVRQHLPDLYAAAGGVNIWALVAAVVLLSSSVNDIQRLLFCLRRPSSTVTMPDVTETLYCIAVLLYAMREKGINISNRIHYNIFYCLYLQENSCTQATKVKEEPSVWPGKKTIQLTHEQQLILNHKMEPLQVVKIMAFAGTGKTSTLVKYAEKWSQSRFLYVTFNKSIAKQAERVFPSNVICKTFHSMAYGHIGRKYQSKKKLNLFKLTPFMVNSVLAEGKGGFIRAKLVCKTLENFFASADEELTIDHVPIWCKNSQGQRVMVEQSEKLNGVLEASRLWDNMRKLGECTEEAHQMTHDGYLKLWQLSKPSLASFDAIFVDEAQDCTPAIMNIVLSQPCGKIFVGDPHQQIYTFRGAVNALFTVPHTHVFYLTQSFRFGVEIAYVGATILDVCKRVRKKTLVGGNHQSGIRGDAKGQVALLSRTNANVFDEAVRVTEGEFPSRIHLIGGIKSFGLDRIIDIWILLQPEEERRKQNLVIKDKFIRRWVHKEGFSGFKRYVTAAEDKELEAKIAVVEKYNIRIPELVQRIEKCHIEDLDFAEYILGTVHKAKGLEFDTVHVLDDFVKVPCARHNLPQLPHFRVESFSEDEWNLLYVAVTRAKKRLIMTKSLENILTLAG

SEQ ID NO: 33782 - protein, 26 aa, Homo sapiens
GSESLGCDPALRSKMDKQRSEPWSLS

SEQ ID NO: 33783 - protein, 19 aa, Homo sapiens
MSYFGEHFWMGKLRHGAGQ

SEQ ID NO: 33784 - protein, 39 aa, Homo sapiens
LCDLDRHWTGPAGVSTETIRMSYFGEHFWMGKLRHGAGQ

SEQ ID NO: 33785 - protein, 17 aa, Homo sapiens
GTELDSDSDTRSCLEWS

SEQ ID NO: 33786 - protein, 10 aa, Homo sapiens
MEMWSLVTNL

SEQ ID NO: 33787 - protein, 25 aa, Homo sapiens
LQNWDVELEVPPLLGCAGHSHTLHR

SEQ ID NO: 33788 - protein, 57 aa, Homo sapiens
LKRRIELTVEYPWRCGALSPTSNCRTGMWSWKCLLFWAVLVTATLCTARPSPTLPEQ

SEQ ID NO: 33789 - protein, 1395 aa, Homo sapiens
MTGAEIESGAQVKPEKKPGEEVVGGAEIENDVPLVVRPKVRTQAQIMPGARPKNKSKVMPGASTKVETSAVGGARPKSKAKAIPVSRFKEEAQMWAQPRFGAERLSKTERNSQTNIIASPLVSTDSVLVAKTKYLSEDRELVNTDTESFPRRKAHYQAGFQPSFRSKEETNMGSWCCPRPTSKQEASPNSDFKWVDKSVSSLFWSGDEVTAKFHPGNRVKDSNRSMHMANQEANTMSRSQTNQELYIASSSGSEDESVKTPWFWARDKTNTWSGPREDPNSRSRFRSKKEVYVESSSGSEHEDHLESWFGAGKEAKFRSKMRAGKEANNRARHRAKREACIDFMPGSIDVIKKESCFWPEENANTFSRPMIKKEARARAMTKEEAKTKARARAKQEARSEEEALIGTWFWATDESSMADEASIESSLQVEDESIIGSWFWTEEEASMGTGASSKSRPRTDGERIGDSLFGAREKTSMKTGAEATSESILAADDEQVIIGSWFWAGEEVNQEAEEETIFGSWFWVIDAASVESGVGVSCESRTRSEEEEVIGPWFWSGEQVDIEAGIGEEARPGAEEETIFGSWFWAENQTYMDCRAETSCDTMQGAEEEEPIIGSWFWTRVEACVEGDVNSKSSLEDKEEAMIPCFGAKEEVSMKHGTGVRCRFMAGAEETNNKSCFWAEKEPCMYPAGGGSWKSRPEEEEDIVNSWFWSRKYTKPEAIIGSWLWATEESNIDGTGEKAKLLTEEETIINSWFWKEDEAISEATDREESRPEAEEGDIIGSWFWAGEEDRLEPAAETREEDRLAAEKEGIVGSWFGAREETIRREAGSCSKSSPKAEEEEVIIGSWFWEEEASPEAVAGVGFESKPGTEEEEITVGSWFWPEEEASIQAGSQAVEEMESETEEETIFGSWFWDGKEVSEEAGPCCVSKPEDDEEMIVESWFWSRDKAIKETGTVATCESKPENEEGAIVGSWFEAEDEVDNRTDNGSNCGSRTLADEDEAIVGSWFWAGDEAHFESNPSPVFRAICRSTCSVEQEPDPSRRPQSWEEVTVQFKPGPWGRVGFPSISPFRFPKEAASLFCEMFGGKPRNMVLSPEGEDQESLLQPDQPSPEFPFQYDPSYRSVQEIREHLRAKESTEPESSSCNCIQCELKIGSEEFEELLLLMEKIRDPFIHEISKIAMGMRSASQFTRDFIRDSGVVSLIETLLNYPSSRVRTSFLENMIRMAPPYPNLNIIQTYICKVCEETLAYSVDSPEQLSGIRMIRHLTTTTDYHTLVANYMSGFLSLLATGNAKTRFHVLKMLLNLSENLFMTKELLSAEAVSEFIGLFNREETNDNIQIVLAIFENIGNNIKKETVFSDDDFNIEPLISAFHKVEKFAKELQGKTDNQNDPEGDQEN

SEQ ID NO: 33790 - protein, 25 aa, Homo sapiens
VTTGLDIDSNSCFQAYILNHLKIRV

SEQ ID NO: 33791 - protein, 21 aa, Homo sapiens
LGQRLSLVPRSSLKRSLGKRL

SEQ ID NO: 33792 - protein, 35 aa, Homo sapiens
KQEKGAGLRTPPFYAWIRRMIFYMFTTSSLREPPP

SEQ ID NO: 33793 - protein, 15 aa, Homo sapiens
RQLLTYYMKRKWKCR

SEQ ID NO: 33794 - protein, 396 aa, Homo sapiens
MPPCFHNDCSEFVNQPYLLYSVHMKSTKPSLSPSKPQSSLVIPTSLFCKTFPFHFMFDKDMTILQFGNGIRRLMNRRDFQGKPNFEEYFEILTPKINQTFSGIMTMLNMQFVVRVRRWDNSVKKSSRVMDLKGQMIYIVESSAILFLGSPCVDRLEDFTGRGLYLSDIPIHNALRDVVLIGEQARAQDGLKKRLGKLKATLEQAHQALEEEKKKTVDLLCSIFPCEVAQQLWQGQVVQAKKFSNVTMLFSDIVGFTAICSQCSPLQVITMLNALYTRFDQQCGELDVYKVETIGDAYCVAGGLHKESDTHAVQIALMALKMMELSDEVMSPHGEPIKMRIGLHSGSVFAGVVGVKMPRYCLFGNNVTLANKFESCSVPRKINVSPTTYRHPSYQCP

SEQ ID NO: 33795 - protein, 195 aa, Homo sapiens
MMMPVVDPVVREKQLQQELLLIQQQQQIQKQLLIAEFQKQHENLTRQHQAQLQEHIKLQQELLAIKQQQELLEKEQKLEQQRQEQEVERHRREQQLPPLRGKDRGRERAVASTEVKQKLQEFLLSKSATKDTPTNGKNHSVSRHPKLWYTAAHHTSLDQSSPPLSGTSPSYKYTLPGAQDAKDDFPLRKTVSGIT

SEQ ID NO: 33796 - protein, 8 aa, Homo sapiens
KTVSYDFL

SEQ ID NO: 33797 - protein, 1739 aa, Homo sapiens
MDPEQSVKGTKKAEGSPRKRLTKGEAIQTSVSSSVPYPGSGTAATQESPAQELLAPQPFPGPSSVLREGSQEKTGQQQKPPKRPPIEASVHISQLPQHPLTPAFMSPGKPEHLLEGSTWQLVDPMRPGPSGSFVAPGLHPQSQLLPSHASIIPPEDLPGVPKVFVPRPSQVSLKPTEEAHKKERKPQKPGKYICQYCSRPCAKPSVLQKHIRSHTGERPYPCGPCGFSFKTKSNLYKHRKSHAHRIKAGLASGMGGEMYPHGLEMERIPGEEFEEPTEGESTDSEEETSATSGHPAELSPRPKQPLLSSGLYSSGSHSSSHERCSLSQSSTAQSLEDPPPFVEPSSEHPLSHKPEDTHTIKQKLALRLSERKKVIDEQAFLSPGSKGSTESGYFSRSESAEQQVSPPNTNAKSYAEIIFGKCGRIGQRTAMLTATSTQPLLPLSTEDKPSLVPLSVPRTQVIEHITKLITINEAVVDTSEIDSVKPRRSSLSRRSSMESPKSSLYREPLSSHSEKTKPEQSLLSLQHPPSTAPPVPLLRSHSMPSAACTISTPHHPFRGSYSFDDHITDSEALSHSSHVFTSHPRMLKRQPAIELPLGGEYSSEEPGPSSKDTASKPSDEVEPKESELTKKTKKGLKTKGVIYECNICGARYKKRDNYEAHKKYYCSELQIAKPISAGTHTSPEAEKSQIEHEPWSQMMHYKLGTTLELTPLRKRRKEKSLGDEEEPPAFESTKSQFGSPGPSDAARNLPLESTKSPAEPSKSVPSLEGPTGFQPRTPKPGSGSESGKERRTTSKEISVIQHTSSFEKSDSLEQPSGLEGEDKPLAQFPSPPPAPHGRSAHSLQPKLVRQPNIQVPEILVTEEPDRPDTEPEPPPKEPEKTEEFQWPQRSQTLAQLPAEKLPPKKKRLRLAEMAQSSGESSFESSVPLSRSPSQESNVSLSGSSRSASFERDDHGKAEAPSPSSDMRPKPLGTHMLTVPSHHPHAREMRRSASEQSPNVSHSAHMTETRSKSFDYGSLSLTGPSAPAPVAPPARVAPPERRKCFLVRQASLSRPPESELEVAPKGRQESEEPQPSSSKPSAKSSLSQISSAATSHGGPPGGKGPGQDRPPLGPTVPYTEALQVFHHPVAQTPLHEKPYLPPPVSLFSFQHLVQHEPGQSPEFFSTQAMSSLLSSPYSMPPLPPSLFQAPPLPLQPTVLHPGQLHLPQLMPHPANIPFRQPPSFLPMPYPTSSALSSGFFLPLQSQFALQLPGDVESHLPQIKTSLAPLATGSAGLSPSTEYSSDIRLPPVAPPASSSAPTSAPPLALPACPDTMVSLVVPVRVQTNMPSYGSAMYTTLSQILVTQSQGSSATVALPKFEEPPSKGTTVCGADVHEVGPGPSGLSEEQSRAFPTPYLRVPVTLPERKGTSLSSESILSLEGSSSTAGGSKRVLSPAGSLELTMETQQQKRVKEEEASKADEKLELVKPCSVVLTSTEDGKRPEKSHLGNQGQGRRELEMLSSLSSDPSDTKEIPPLPHPALSHGTAPGSEALKEYPQPSGKPHRRGLTPLSVKKEDSKEQPDLPSLAPPSSLPLSETSSRPAKSQEGTDSKKVLQFPSLHTTTNVSWCYLNYIKPNHIQHADRRSSVYAGWCISLYNPNLPGVSTKAALSLLRSKQKVSKETYTMATAPHPEAGRLVPSSSRKPRMTEVHLPSLVSPEGQKDLARVEKEEERRGEPEEDAPASQRGEPARIKIFEGGRRA

SEQ ID NO: 33798 - protein, 1748 aa, Homo sapiens
IASEVFVKVMDPEQSVKGTKKAEGSPRKRLTKGEAIQTSVSSSVPYPGSGTAATQESPAQELLAPQPFPGPSSVLREGSQEKTGQQQKPPKRPPIEASVHISQLPQHPLTPAFMSPGKPEHLLEGSTWQLVDPMRPGPSGSFVAPGLHPQSQLLPSHASIIPPEDLPGVPKVFVPRPSQVSLKPTEEAHKKERKPQKPGKYICQYCSRPCAKPSVLQKHIRSHTGERPYPCGPCGFSFKTKSNLYKHRKSHAHRIKAGLASGMGGEMYPHGLEMERIPGEEFEEPTEGESTDSEEETSATSGHPAELSPRPKQPLLSSGLYSSGSHSSSHERCSLSQSSTAQSLEDPPPFVEPSSEHPLSHKPEDTHTIKQKLALRLSERKKVIDEQAFLSPGSKGSTESGYFSRSESAEQQVSPPNTNAKSYAEIIFGKCGRIGQRTAMLTATSTQPLLPLSTEDKPSLVPLSVPRTQVIEHITKLITINEAVVDTSEIDSVKPRRSSLSRRSSMESPKSSLYREPLSSHSEKTKPEQSLLSLQHPPSTAPPVPLLRSHSMPSAACTISTPHHPFRGSYSFDDHITDSEALSHSSHVFTSHPRMLKRQPAIELPLGGEYSSEEPGPSSKDTASKPSDEVEPKESELTKKTKKGLKTKGVIYECNICGARYKKRDNYEAHKKYYCSELQIAKPISAGTHTSPEAEKSQIEHEPWSQMMHYKLGTTLELTPLRKRRKEKSLGDEEEPPAFESTKSQFGSPGPSDAARNLPLESTKSPAEPSKSVPSLEGPTGFQPRTPKPGSGSESGKERRTTSKEISVIQHTSSFEKSDSLEQPSGLEGEDKPLAQFPSPPPAPHGRSAHSLQPKLVRQPNIQVPEILVTEEPDRPDTEPEPPPKEPEKTEEFQWPQRSQTLAQLPAEKLPPKKKRLRLAEMAQSSGESSFESSVPLSRSPSQESNVSLSGSSRSASFERDDHGKAEAPSPSSDMRPKPLGTHMLTVPSHHPHAREMRRSASEQSPNVSHSAHMTETRSKSFDYGSLSLTGPSAPAPVAPPARVAPPERRKCFLVRQASLSRPPESELEVAPKGRQESEEPQPSSSKPSAKSSLSQISSAATSHGGPPGGKGPGQDRPPLGPTVPYTEALQVFHHPVAQTPLHEKPYLPPPVSLFSFQHLVQHEPGQSPEFFSTQAMSSLLSSPYSMPPLPPSLFQAPPLPLQPTVLHPGQLHLPQLMPHPANIPFRQPPSFLPMPYPTSSALSSGFFLPLQSQFALQLPGDVESHLPQIKTSLAPLATGSAGLSPSTEYSSDIRLPPVAPPASSSAPTSAPPLALPACPDTMVSLVVPVRVQTNMPSYGSAMYTTLSQILVTQSQGSSATVALPKFEEPPSKGTTVCGADVHEVGPGPSGLSEEQSRAFPTPYLRVPVTLPERKGTSLSSESILSLEGSSSTAGGSKRVLSPAGSLELTMETQQQKRVKEEEASKADEKLELVKPCSVVLTSTEDGKRPEKSHLGNQGQGRRELEMLSSLSSDPSDTKEIPPLPHPALSHGTAPGSEALKEYPQPSGKPHRRGLTPLSVKKEDSKEQPDLPSLAPPSSLPLSETSSRPAKSQEGTDSKKVLQFPSLHTTTNVSWCYLNYIKPNHIQHADRRSSVYAGWCISLYNPNLPGVSTKAALSLLRSKQKVSKETYTMATAPHPEAGRLVPSSSRKPRMTEVHLPSLVSPEGQKDLARVEKEEERRGEPEEDAPASQRGEPARIKIFEGGRRA

SEQ ID NO: 33799 - protein, 9 aa, Homo sapiens
MQPALTLPE

SEQ ID NO: 33800 - protein, 22 aa, Homo sapiens
RSWILNKVSRAPRRLREVPGSG

SEQ ID NO: 33801 - protein, 13 aa, Homo sapiens
KKSLRSEAPFFVS

SEQ ID NO: 33802 - protein, 16 aa, Homo sapiens
QRHQENLMELKSIFSP

SEQ ID NO: 33803 - protein, 470 aa, Homo sapiens
MKSLQEALQNQLKETSEKAEKHQATDYEELEKQLKEVFKERSTILRQLTKTSRELDGIKVNLQSLKNDEQSAKTDVQKLLELGQKQREEMKSLQEALQNQLKETSEKAEKHQATDYEELEKQLKEVFKERSTILRQLTKTSRELDGIKVNLQSLKNDEQSAKTDVQKLLELGQKQREEMKSLQEALQNQLKETSEKAEKHQATDYEELEKQLKEVFKERSTILRQLTKTSRELDGIKVNLQSLKNDEQSAKTDVQKLLELGQKQREEMKSLQEALQNQLKETSEKAEKHQATDYEELEKQLKEVFKERSTILRQLTKTSRELDGIKVNLQSLKNDEQSAKTDVQKLLELGQKQREEMKSLQEALQNQLKETSEKAEKHQATDYEELEKQLKEVFKERSTILRQLTKTSRELDGIKVNLQSLKNDEQSAKTDVQKLLELGQKQREEMKSLQEALQNQLKETSEKAEKHQAT

SEQ ID NO: 33804 - protein, 654 aa, Homo sapiens
KQLKEVFKERSTILRQLTKTSRELDGIKVNLQSLKNDEQSAKTDVQKLLELGQKQREEMKSLQEALQNQLKETSEKAEKHQATINFLKTEVERKSKMIRDLQNEDYEELEKQLKEVFKERSTILRQLTKTSRELDGIKVNLQSLKNDEQSAKTDVQKLLELGQKQREEMKSLQEALQNQLKETSEKAEKHQATINFLKTEVERKSKMIRDLQNEDYEELEKQLKEVFKERSTILRQLTKTSRELDGIKVNLQSLKNDEQSAKTDVQKLLELGQKQREEMKSLQEALQNQLKETSEKAEKHQATINFLKTEVERKSKMIRDLQNEDYEELEKQLKEVFKERSTILRQLTKTSRELDGIKVNLQSLKNDEQSAKTDVQKLLELGQKQREEMKSLQEALQNQLKETSEKAEKHQATINFLKTEVERKSKMIRDLQNEDYEELEKQLKEVFKERSTILRQLTKTSRELDGIKVNLQSLKNDEQSAKTDVQKLLELGQKQREEMKSLQEALQNQLKETSEKAEKHQATINFLKTEVERKSKMIRDLQNEDYEELEKQLKEVFKERSTILRQLTKTSRELDGIKVNLQSLKNDEQSAKTDVQKLLELGQKQREEMKSLQEALQNQLKETSEKAEKHQATINFLKTEVERKSKMIRDLQNE

SEQ ID NO: 33805 - protein, 949 aa, Homo sapiens
MERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEAAAREIVWLEREERARQHYEKHLEERKKRLEEQRQKEERRRAAVEEKRRQRLEEDKERHEAVVRRTMERSQKPKQKHNRWSWGGSLHGSPSIHSADPDRRSVSTMNLSKYVDPVISKRLSSSSATLLNSPDRARRLQLSPWESSVVNRLLTPTHSFLARSKSTAALSGEA

SEQ ID NO: 33806 - protein, 8 aa, Homo sapiens
MGTRCFLC

SEQ ID NO: 33807 - protein, 308 aa, Homo sapiens
MGGACSSFTTSSSPTIYSTSVTDSKAMQVESCSSAVGVSNRGVSEKQLTSNTVQQHPSTPKRHTVLYISPPPEDLLDNSRMSCQDEGCGLESEQSCSMWMEDSPSNFSNMSTSSYNDNTEVPRKSRKRNPKQRPGVKRRDCEESNMDIFDADSAKAPHYVLSQLTTDNKGNSKAGNGTLENQKGTGVKKSPMLCGQYPVKSEGKELKIVVQPETQHRARYLTEGSRGSVKDRTQQGFPTVKLEGHNEPVVLQVFVGNDSGRVKPHGFYQACRVTGRNTTPCKEVDIEGTTVIEVGLDPSNNMTLAICL

SEQ ID NO: 33808 - protein, 15 aa, Homo sapiens
GRLASSSCCCCWICL

SEQ ID NO: 33809 - protein, 47 aa, Homo sapiens
MLLQLPPLPPWAVLAAPLPPLPALPFILPQSPTARLCKWRAAPQPWG

SEQ ID NO: 33810 - protein, 12 aa, Homo sapiens
QPERMPHKGGRL

SEQ ID NO: 33811 - protein, 70 aa, Homo sapiens
RGKTLTRGAQMCEAFYCESGQTSEISEPHIRAPWNPAAPSQSQHAEQNLRIALTHQPSNIRGENSHQQLL

SEQ ID NO: 33812 - protein, 9 aa, Homo sapiens
IPQEKGRWI

SEQ ID NO: 33813 - protein, 28 aa, Homo sapiens
AERPASQSPGDFILRSRHSNTTGKMGRC

SEQ ID NO: 33814 - protein, 2689 aa, Homo sapiens
MAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPEGKGSRAADKAVAMVMKEIPREESAEEKPLLTMTSQLVNEQQESRPLLSPSIDDFLCETKSEAIARPVTSNTAVLTTGLDLLDLSEPVSQTQTKAKKSEPSSKTSSLKKKADGSDLISTDAEQRGQPLRVPETSSLDLDIQTQLEKWDDVKFHGDRNTKGHPMAERKSSSSRTGSKELLWSSEHRSQPELSGGKSALNSESASELELVAPTQARLTKEHRWGSALLSRNHSLEEEFERAKAAVESDTEFWDKMQAEWEEMARRNWISENQEAQNQVTISASEKGYYFHTENPFKDWPGAFEEGLKRLKEGDLPVTILFMEAAILQDPGDAEAWQFLGITQAENENEQAAIVALQRCLELQPNNLKALMALAVSYTNTGHQQDACDALKNWIKQNPKYKYLVKSKKGSPGLTRRMSKSPVDSSVLEGVKELYLEAAHQNGDMIDPDLQTGLGVLFHLSGEFNRAIDAFNAALTVRPE

SEQ ID NO: 33815 - protein, 447 aa, Homo sapiens
MDSGYVEDSEESSSEWPWRRGSQERRGHRRPGQKFIRIYKLFKSTSQLVLRRDSRSLEGSSDTALPLRRAGSLCSPLDEPVSPPSRAQRSRSLPQPKLGTQLPSWLLAPASRPQRRRPFLSGDEDPKASTLRVVVFGSDRISGKVARAYSNLRRLENNRPLLTRFFKLQFFYVPVKRSHGTSPGACPPPRSQTPSPPTDSPRHASPGELGTTPWEESTNDISHYLGMLDPWYERNVLGLMHLPPEVLCQQSLKAEAQALEGSPTQLPILADMLLYYCRFAARPVLLQVYQTELTFITGEKTTEIFIHSLELGHSAATRAIKASGPGSKRLGIDGDREAVPLTLQIIYSKGAISGRSRWSNLEKVCTSVNLNKACRKQEELDSSMEALTLNLTEVVKRQNSKSKKGFNQISTSQIKVDKVQIIGSNSCPFAVCLDQDERKILQSVVRR

SEQ ID NO: 33816 - protein, 47 aa, Homo sapiens
RWRRTWKLTGTVPREIPCSPPALWRPMTPPCPLHPPRPRGRPSRAIC

SEQ ID NO: 33817 - protein, 600 aa, Homo sapiens
MSRIKSTLNSVSKAVFGNQNEMISRLAQFKPSSQILRKVSDSGWLKQKNIKQAIKSLKKYSDKSAEKSPFPEEKSHIIDKEEDIGKRSLFHYTSSITTKFGDSFYFLSNHINSYFKRKEKMSQQKENEHFRDKSELEDKKVEEGKLRSPDPGILAYKPGSESVHTVDKPTSPSAIPDVLQVSTKQSIANFLSRPTEGVQALVGGYIGGLVPKLKYDSKSQSEEQEEPAKTDQAVSKDRNAEEKKRLSLQREKIIARVSIDNRTRALVQALRRTTDPKLCITRVEELTFHLLEFPEGKGVAVKERIIPYLLRLRQIKDETLQAAVREILALIGYVDPVKGRGIRILSIDGGGTRGVVALQTLRKLVELTQKPVHQLFDYICGVSTGAILAFMLGLFHMPLDECEELYRKLGSDVFSQNVIVGTVKMSWSHAFYDSQTWENILKDRMGSALMIETARNPTCPKVAAVSTIVNRGITPKAFVFRNYGHFPGINSHYLGGCQYKMWQAIRASSAAPGYFAEYALGNDLHQDGGLLLNNPSALAMHECKCLWPDVPLECIVSLGTGRYESDVRNTVTYTSLKTKLSNVINSATDTEGKTMNYGIS

SEQ ID NO: 33818 - protein, 17 aa, Homo sapiens
ALLLSKQPWFTYWDFET

SEQ ID NO: 33819 - protein, 28 aa, Homo sapiens
MIFSDMNTVSGSPKVHPPNGTRFYTFQA

SEQ ID NO: 33820 - protein, 51 aa, Homo sapiens
KNNSKCYHCVCKKDGADFILPSSLPQCMHGFICTLSSLLCICSSLWIILSQ

SEQ ID NO: 33821 - protein, 19 aa, Homo sapiens
ALCSASVAPCGLYCLSDQK

SEQ ID NO: 33822 - protein, 32 aa, Homo sapiens
GLPDLGHIDLVLAIDWQHGSSQLQSHQGAASF

SEQ ID NO: 33823 - protein, 25 aa, Homo sapiens
IWFWPLTGNMAVANCRATREQPHSD

SEQ ID NO: 33824 - protein, 20 aa, Homo sapiens
RHIEENQLPKLLAAALLRPA

SEQ ID NO: 33825 - protein, 226 aa, Homo sapiens
LSITKTLMGKRDTADIISTVEFNHTGELLATGDKGGRVVIFQREPESKNAPHSQGEYDVYSTFQSHEPEFDYLKSLEIEEKINKIKWLPQQNAAHSLLSTNDKTIKLWKITERDKRPEGYNLKDEEGKLKDLSTVTSLQVPVLKPMDLMVEVSPRRIFANGHTYHINSISVNSDCETYMSADDLRINLWHLAITDRSFTPGRIQKCPGCPVVMGMAGTCIFVSSCT

SEQ ID NO: 33826 - protein, 66 aa, Homo sapiens
MELKVWVDGVQRIVCGVTEVTTCQEVVIALAQAIGACVDHPRIPVWCCPSSRLPHSHWLGDSCLLS

SEQ ID NO: 33827 - protein, 72 aa, Homo sapiens
VTGRCTMELKVWVDGVQRIVCGVTEVTTCQEVVIALAQAIGACVDHPRIPVWCCPSSRLPHSHWLGDSCLLS

SEQ ID NO: 33828 - protein, 22 aa, Homo sapiens
VWCCPSSRLPHSHWLGDSCLLS

SEQ ID NO: 33829 - protein, 32 aa, Homo sapiens
LAGAPWNLKYGWMEFRGLFVESLKSQLARRLS

SEQ ID NO: 33830 - protein, 15 aa, Homo sapiens
ADYTDLVFSTPCSCS

SEQ ID NO: 33831 - protein, 2789 aa, Homo sapiens
MKSAPVMLTLSDSKHVVLPVDDDSDLNVVASFDRRGEYIYTGNAKGKILVLKTDSQDLVASFRVTTGTSNTTAIKSIEFARKGSCFLINTADRIIRVYDGREILTCGRDGEPEPMQKLQDLVNRTPWKKCCFSGDGEYIVAGSARQHALYIWEKSIGNLVKILHGTRGELLLDVAWHPVRPIIASISSGVVSIWAQNQVENWSAFAPDFKELDENVEYEERESEFDIEDEDKSEPEQTGADAAEDEEVDVTSVDPIAAFCSSDEELEDSKALLYLPIAPEVEDPEENPYGPPPDAVQTSLMDEGASSEKKRQSSADGSQPPKKKPKTTNIELQGVPNDEVHPLLGVKGDGKSKKKQAGRPKGSKESFGQNYPEEADGTLDCISMALTCTFNRWGTLLAVGCNDGRIVIWDFLTRGIAKIISAHIHPVCSLCWSRDGHKLVSASTDNIVSQWDVLSGDCDQRFRFPSPILKVQYHPRDQNKVLVCPMKSAPVMLTLSDSKHVVLPVDDDSDLNVVASFDRRGEYIYTGNAKGKILVLKTDSQDLVASFRVTTGTSNTTAIKSIEFARKGSCFLINTADRIIRVYDGREILTCGRDGEPEPMQKLQDLVNRTPWKKCCFSGDGEYIVAGSARQHALYIWEKSIGNLVKILHGTRGELLLDVAWHPVRPIIASISSGVVSIWAQNQVENWSAFAPDFKELDENVEYEERESEFDIEDEDKSEPEQTGADAAEDEEVDVTSVDPIAAFCSSDEELEDSKALLYLPIAPEVEDPEENPYGPPPDAVQTSLMDEGASSEKKRQSSADGSQPPKKKPKTTNIELQGVPNDEVHPLLGVKGDGKSKKKQAGRPKGSKESFGQNYPEEADGTLDCISMALTCTFNRWGTLLAVGCNDGRIVIWDFLTRGIAKIISAHIHPVCSLCWSRDGHKLVSASTDNIVSQWDVLSGDCDQRFRFPSPILKVQYHPRDQNKVLVCPMKSAPVMLTLSDSKHVVLPVDDDSDLNVVASFDRRGEYIYTGNAKGKILVLKTDSQDLVASFRVTTGTSNTTAIKSIEFARKGSCFLINTADRIIRVYDGREILTCGRDGEPEPMQKLQDLVNRTPWKKCCFSGDGEYIVAGSARQHALYIWEKSIGNLVKILHGTRGELLLDVAWHPVRPIIASISSGVVSIWAQNQVENWSAFAPDFKELDENVEYEERESEFDIEDEDKSEPEQTGADAAEDEEVDVTSVDPIAAFCSSDEELEDSKALLYLPIAPEVEDPEENPYGPPPDAVQTSLMDEGASSEKKRQSSADGSQPPKKKPKTTNIELQGVPNDEVHPLLGVKGDGKSKKKQAGRPKGSKESFGQNYPEEADGTLDCISMALTCTFNRWGTLLAVGCNDGRIVIWDFLTRGIAKIISAHIHPVCSLCWSRDGHKLVSASTDNIVSQWDVLSGDCDQRFRFPSPILKVQYHPRDQNKVLVCPMKSAPVMLTLSDSKHVVLPVDDDSDLNVVASFDRRGEYIYTGNAKGKILVLKTDSQDLVASFRVTTGTSNTTAIKSIEFARKGSCFLINTADRIIRVYDGREILTCGRDGEPEPMQKLQDLVNRTPWKKCCFSGDGEYIVAGSARQHALYIWEKSIGNLVKILHGTRGELLLDVAWHPVRPIIASISSGVVSIWAQNQVENWSAFAPDFKELDENVEYEERESEFDIEDEDKSEPEQTGADAAEDEEVDVTSVDPIAAFCSSDEELEDSKALLYLPIAPEVEDPEENPYGPPPDAVQTSLMDEGASSEKKRQSSADGSQPPKKKPKTTNIELQGVPNDEVHPLLGVKGDGKSKKKQAGRPKGSKESFGQNYPEEADGTLDCISMALTCTFNRWGTLLAVGCNDGRIVIWDFLTRGIAKIISAHIHPVCSLCWSRDGHKLVSASTDNIVSQWDVLSGDCDQRFRFPSPILKVQYHPRDQNKVLVCPMKSAPVMLTLSDSKHVVLPVDDDSDLNVVASFDRRGEYIYTGNAKGKILVLKTDSQDLVASFRVTTGTSNTTAIKSIEFARKGSCFLINTADRIIRVYDGREILTCGRDGEPEPMQKLQDLVNRTPWKKCCFSGDGEYIVAGSARQHALYIWEKSIGNLVKILHGTRGELLLDVAWHPVRPIIASISSGVVSIWAQNQVENWSAFAPDFKELDENVEYEERESEFDIEDEDKSEPEQTGADAAEDEEVDVTSVDPIAAFCSSDEELEDSKALLYLPIAPEVEDPEENPYGPPPDAVQTSLMDEGASSEKKRQSSADGSQPPKKKPKTTNIELQGVPNDEVHPLLGVKGDGKSKKKQAGRPKGSKESFGQNYPEEADGTLDCISMALTCTFNRWGTLLAVGCNDGRIVIWDFLTRGIAKIISAHIHPVCSLCWSRDGHKLVSASTDNIVSQWDVLSGDCDQRFRFPSPILKVQYHPRDQNKVLVCPMKSAPVMLTLSDSKHVVLPVDDDSDLNVVASFDRRGEYIYTGNAKGKILVLKTDSQDLVASFRVTTGTSNTTAIKSIEFARKGSCFLINTADRIIRVYDGREILTCGRDGEPEPMQKLQDLVNRTPWKKCCFSGDGEYIVAGSARQHALYIWEKSIGNLVKILHGTRGELLLDVAWHPVRPIIASISSGVVSIWAQNQVENWSAFAPDFKELDENVEYEERESEFDIEDEDKSEPEQTGADAAEDEEVDVTSVDPIAAFCSSDEELEDSKALLYLPIAPEVEDPEENPYGPPPDAVQTSLMDEGASSEKKRQSSADGSQPPKKKPKTTNIELQGVPNDEVHPLLGVKGDGKSKKKQAGRPKGSK

SEQ ID NO: 33832 - protein, 16 aa, Homo sapiens
KSNIIHEIRTRFSCVP

SEQ ID NO: 33833 - protein, 247 aa, Homo sapiens
MASQPPEDTAESQASDELECKICYNRYNLKQRKPKVLECCHRVCAKCLYKIIDFGDSPQGVIVCPFCRFETCLPDDEVSSLPDDNNILVNLTCGGKGKKCLPENPTELLLTPKRLASLVSPSHTSSNCLVITIMEVQRESSPSLSSTPVVEFYRPASFDSVTTVSHNWTVWNCTSLLFQTSIRVLVWLLGLLYFSSLPLGIYLLVSKKVTLGVVFVSLVPSSLVILMVYGFCQCVCHEFLDCMAPPS

SEQ ID NO: 33834 - protein, 1037 aa, Homo sapiens
MRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQ

SEQ ID NO: 33835 - protein, 1095 aa, Homo sapiens
VRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQISPGANSASLPGHPNKVICERVRLQSLFPLLPSDQNTTVQEDAHFKAFFQSEDSPSPKRQRLSHSVFDYTSASPAPSPPMRPWEMTSNRQPPSVRPSQHHFSGERCNTPARNRRSPPVRRQRGRRDRLSRHNSISQDENYHHLPYAQQQAIEEPRAFHPPNVSPRLLHPAAHPPQQNAVMVDIHDQ

SEQ ID NO: 33836 - protein, 25 aa, Homo sapiens
MGYKLQDLTDVQIMARLQEESMCSF

SEQ ID NO: 33837 - protein, 19 aa, Homo sapiens
KRRNWKCMSVFWLRLGKAA

SEQ ID NO: 33838 - protein, 8 aa, Homo sapiens
AEYFRIGG

SEQ ID NO: 33839 - protein, 391 aa, Homo sapiens
MDGKVAVQECGPPAVSWVPEEGEKLDQEDEDQVKDRGQWTNKMEFVLSVAGEIIGLGNVWRFPYLCYKNGGGAFFIPYFIFFFVCGIPVFFLEVALGQYTSQGSVTAWRKICPLFQGIGLASVVIESYLNVYYIIILAWALFYLFSSFTSELPWTTCNNFWNTEHCTDFLNHSGAGTVTPFENFTSPVMEFWERRVLGITSGIHDLGSLRWELALCLLLAWVICYFCIWKGVKSTGKVVYFTATFPYLMLVILLIRGVTLPGAYQGIIYYLKPDLFRLKDPQVWMDAGTQIFFSFAICQGCLTALGSYNKYHNNCYKDCIALCFLNSGTSFVAGFAIFSILGFMSQEQGVPISEVAESGECYWGGLEAVSLVQTSGSKRLEAFPLCHLHSG

SEQ ID NO: 33840 - protein, 13 aa, Homo sapiens
ADHRSRCWGLRET

SEQ ID NO: 33841 - protein, 9 aa, Homo sapiens
LTTGAGAGD

SEQ ID NO: 33842 - protein, 283 aa, Homo sapiens
MTSMASLFSFTSPAVKRLLGWKQGDEEEKWAEKAVDALVKKLKKKKGAMEELEKALSSPGQPSKCVTIPRSLDGRLQVSHRKGLPHVIYCRVWRWPDLQSHHELKPLDICEFPFGSKQKEVCINPYHYKRVESPVLPPVLVPRHNEFNPQHSLLVQFRNLSHNEPHMPQNATFPDSFHQPNNTPFPLSPNSPYPPSPASSTYPNSPASSGPGSPFQLPADTPPPAYMPPDDQMGQDNSQPMDTSNNMIPQIMPSISSRERKLLKLLKYLLLYSKKLKCPEICL

SEQ ID NO: 33843 - protein, 9 aa, Homo sapiens
LELLLRTCV

SEQ ID NO: 33844 - protein, 21 aa, Homo sapiens
KKHMALVKINVTPPFLIGTSA

SEQ ID NO: 33845 - protein, 213 aa, Homo sapiens
MRTSAEYFRLALSKLQSCDLFDEFDKMNNGPVLGHEEEVGRRTTFRLFYPESVFSDPIHNDPNTTVILTAFKPHDLRWLLELLMGDKINTNGFWKKPALNLIYKPYQIRILDPFIIRTAAYELLHFPKVFPKNQKPKHPTTGIIAITLAFYICHEVHLAGFKYNFSDLKSPLHYYGNATMSLMNKNAYHNVTAEQLFLKDIIEKNLVINLTQD

SEQ ID NO: 33846 - protein, 14 aa, Homo sapiens
TTTAMCPTSWRQSR

SEQ ID NO: 33847 - protein, 29 aa, Homo sapiens
AAEDHLRGGHHPHRVCLPQAGQGLPRLSR

SEQ ID NO: 33848 - protein, 668 aa, Homo sapiens
MIYMDDGVSSFVQIRGSVPLFWEQPGLQVGSHHLRLHRGLEANAPAFDRNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFDRNQLLHVPLRQHQVSCCDWLLKIICGVVTIRTVYASHKQAKACLVSRVSCERTGTRFHTRGVNDDGHVSNFVETEQMIYMDDGVSSFVQIRGSVPLFWEQPGLQVGSHHLRLHRGLEANAPAFD

SEQ ID NO: 33849 - protein, 20 aa, Homo sapiens
LQSQARLCLPARQTPSRTRR

SEQ ID NO: 33850 - protein, 67 aa, Homo sapiens
QNFHREAIFNRNEGFHGYLGSPRNKSSSWLCNCSLRQGSAFQPARRPPGRGDDRRQHGGHPRGLRRS

SEQ ID NO: 33851 - protein, 2489 aa, Homo sapiens
MTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVKESQEADEQLVAEVVEKCSSKTCSKPSENEVPQQAIDSHSVKNFREEPEHDFSKISIVRPFSIETKDSTDISAVLGTKAAHGCVTAVSGKALPSSPPDALQDEAMTEGSMGVTLEASAEADLKAGNSCPELVPSRRSKLRKPKPVPLRKKAIGGEFSDTNAAVEGTPLPKASYHFSPEELDENTSPLLGDARFQKSPPDLKETPGTLSSDTNDSGVELGEESRSSPLKLEFDFTEDTGNIEARKALPRKLGRKLGSTLTPKIQKDGISKSAGLEQPTDPVARDGPLSQTSSKPDPSQWESPSFNPFGSHSVLQNSPPLSSEGSYHFDPDNFDESMDPFKPTTTLTSSDFCSPTGNHVNEILESPKKAKSRLITSGCKVKKHETQSLALDACSRDEGAVISQISDISNRDGHATDEEKLASTSCGQKSAGAEVK

SEQ ID NO: 33852 - protein, 84 aa, Homo sapiens
QLPLRPSLASSCGRPCSSHATSPGLGWAKCDVMRAGTRHPGAAWTEDCGRAALGIYLHAPALLQLPQRAALHRAHPLHRAHLRL

SEQ ID NO: 33853 - protein, 291 aa, Homo sapiens
MHLRCYSCPNEQRYIVRILFIVPIYAFDSWLSLLFFTNDQYYVYFGTVRDCYEALVIYNFLSLCYEYLGGESSIMSEIRGKPIESSCMYGTCCLWGKTYSIGFLRFCKQATLQFCVVKPLMAVSTVVLQAFGKYRDGDFDVTSGYLYVTIIYNISVSLALYALFLFYFATRELLSPYSPVLKFFMVKSVIFLSFWQGMLLAILEKCGAIPKIHSARVSVGEGTVAAGYQDFIICVEMFFAALALRHAFTYKVYADKRLDAQARVSHGATCGEQVPPGTEDRERVLRRYLPG

SEQ ID NO: 33854 - protein, 2099 aa, Homo sapiens
VGQAGVQIGNACWELFCLEHGIQADGTFDAQASKINDDDSFTTFFSETGNGKHVPRAVMIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKRECISVHVGQAGVQIGNACWELFCLEHGIQADGTFDAQASKINDDDSFTTFFSETGNGKHVPRAVMIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKRECISVHVGQAGVQIGNACWELFCLEHGIQADGTFDAQASKINDDDSFTTFFSETGNGKHVPRAVMIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKRECISVHVGQAGVQIGNACWELFCLEHGIQADGTFDAQASKINDDDSFTTFFSETGNGKHVPRAVMIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKRECISVHVGQAGVQIGNACWELFCLEHGIQADGTFDAQASKINDDDSFTTFFSETGNGKHVPRAVMIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFKRECISVHVGQAGVQIGNACWELFCLEHGIQADGTFDAQASKINDDDSFTTFFSETGNGKHVPRAVMIDLEPTVVDEVRAGTYRQLFHPEQLITGKEDAANNYARGHYTVGKESIDLVLDRIRKLTDACSGLQGFLIFHSFGGGTGSGFTSLLMERLSLDYGKKSKLEFAIYPAPQVSTAVVEPYNSILTTHTTLEHSDCAFMVDNEAIYDICRRNLDIERPTYTNLNRLISQIVSSITASLRFDGALNVDLTEFQTNLVPYPRIHFPLVTYAPIISAEKAYHEQLSVAEITSSCFEPNSQMVKCDPRHGKYMACCMLYRGDVVPKDVNVAIAAIKTKRTIQFVDWCPTGFK

SEQ ID NO: 33855 - protein, 84 aa, Homo sapiens
MDSSQQKTFRGHDAPVLSLSFDPKDIFLASASCDGSVRVWQISDQTCAISWPLLQKCNDVINAKSICRLAWQPKSGKFYCDLWK

SEQ ID NO: 33856 - protein, 19 aa, Homo sapiens
RSSRWYIDSLHYKCKPCGL

SEQ ID NO: 33857 - protein, 135 aa, Homo sapiens
MAQETNHSQVPMLCSTGCGFYGNPRTNGMCSVCYKEHLQRQNSSNGRISPPATSVSSLSESLPVQCTDGSVPEAQSALDSTSSSMQPSPVSNQSLLSESVASSQLDSTSVDKAVPETEDVQGMNLKSAAVKHRRL

SEQ ID NO: 33858 - protein, 10 aa, Homo sapiens
LLMRIGKAES

SEQ ID NO: 33859 - protein, 873 aa, Homo sapiens
MASRRKSTTPCMVLASEQDPDLELISDLDEGPPVLTPVENTRAESISSDEEVHESVDSDNQQNKKVEGGYECKYCTFQTPDLNMFTFHVDSEHPNVVLNSSYVCVECNFLTKRYDALSEHNLKYHPGEENFKLTMVKRNNQTIFEQTINDLTFDGSFVKEENAEQAESTEVSSSGISISKTPIMKMMKNKVENKRIAVHHNSVEDVPEEKENEIKPDREEIVENPSSSASESNTSTSIVNRIHPSTASTVVTPAAVLPGLAQVITAVSAQQNSNLIPKVLIPVNSIPTYNAALDNNPLLLNTYNKFPYPTMSEITVLSAQAKYTEEQIKIWFSAQRLKHGVSWTPEEVEEARRKQFNGTVHTVPQTITVIPTHISTGSNGLPSILQTCQIVGQPGLVLTQVAGTNTLPVTAPIALTVAGVPSQNNIQKSQVPAAQPTAETKPATAAVPTSQSVKHETALVNPDSFGIRAKKTKEQLAELKVSYLKNQFPHDSEIIRLMKITGLTKGEIKKWFSDTRYNQRNSKSNQCLHLNNDSSTTIIIDSSDETTESPTVGTAQPKQSWNPFPDFTPQKFKEKTAEQLRVLQASFLNSSVLTDEELNRLRAQTKLTRREIDAWFTEKKKSKALKEEKMEIDESNAGSSKEEAGETSPADESGAPKSGSTGKICKKTPEQLHMLKSAFVRTQWPSPEEYDKLAKESGLARTDIVSWFGDTRYAWKNGNLKWYYYYQSANSSSMNGLSSLRKRGRGRPKGRGRGRPRGRPRGSKRINNWDRGPSLIKFKTGTAILKDYYLKHKFLNEQDLDELVNKSHMGYEQVREWFAERQRRSELGIELFEENEEEDEVIDDQEEDEEETDDSDTWEPPRHVKRKLSKSDD

SEQ ID NO: 33860 - protein, 11 aa, Homo sapiens
LHHEKAANETC

SEQ ID NO: 33861 - protein, 8 aa, Homo sapiens
ASMLFNHH

SEQ ID NO: 33862 - protein, 880 aa, Homo sapiens
AFPHNIRMASRRKSTTPCMVLASEQDPDLELISDLDEGPPVLTPVENTRAESISSDEEVHESVDSDNQQNKKVEGGYECKYCTFQTPDLNMFTFHVDSEHPNVVLNSSYVCVECNFLTKRYDALSEHNLKYHPGEENFKLTMVKRNNQTIFEQTINDLTFDGSFVKEENAEQAESTEVSSSGISISKTPIMKMMKNKVENKRIAVHHNSVEDVPEEKENEIKPDREEIVENPSSSASESNTSTSIVNRIHPSTASTVVTPAAVLPGLAQVITAVSAQQNSNLIPKVLIPVNSIPTYNAALDNNPLLLNTYNKFPYPTMSEITVLSAQAKYTEEQIKIWFSAQRLKHGVSWTPEEVEEARRKQFNGTVHTVPQTITVIPTHISTGSNGLPSILQTCQIVGQPGLVLTQVAGTNTLPVTAPIALTVAGVPSQNNIQKSQVPAAQPTAETKPATAAVPTSQSVKHETALVNPDSFGIRAKKTKEQLAELKVSYLKNQFPHDSEIIRLMKITGLTKGEIKKWFSDTRYNQRNSKSNQCLHLNNDSSTTIIIDSSDETTESPTVGTAQPKQSWNPFPDFTPQKFKEKTAEQLRVLQASFLNSSVLTDEELNRLRAQTKLTRREIDAWFTEKKKSKALKEEKMEIDESNAGSSKEEAGETSPADESGAPKSGSTGKICKKTPEQLHMLKSAFVRTQWPSPEEYDKLAKESGLARTDIVSWFGDTRYAWKNGNLKWYYYYQSANSSSMNGLSSLRKRGRGRPKGRGRGRPRGRPRGSKRINNWDRGPSLIKFKTGTAILKDYYLKHKFLNEQDLDELVNKSHMGYEQVREWFAERQRRSELGIELFEENEEEDEVIDDQEEDEEETDDSDTWEPPRHVKRKLSKSDD

SEQ ID NO: 33863 - protein, 81 aa, Homo sapiens
MDVFVDFTWEEWQLLDPAQKCLYRSVMLENYSNLVSLGYQHTKPDIIFKLEQGEELCMVQAQVPNQTCPSPTSPRTKQFMG

SEQ ID NO: 33864 - protein, 516 aa, Homo sapiens
MHGRKDDAQKQPVKNQLGLNPQSHLPELQLFQAEGKIYKYDHMEKSVNSSSLVSPPQRISSTVKTHISHTYECNFVDSLFTQKEKANIGTEHYKCSERGKAFHQGLHFTIHQIIHTKETQFKCDICGKIFNKKSNLASHQRIHTGEKPYKCNECGKVFHNMSHLAQHRRIHTGEKPYKCNECGKVFNQISHLAQHQRIHTGEKPYKCNECGKVFHQISHLAQHRTIHTGEKPYECNKCGKVFSRNSYLVQHLIIHTGEKPYRCNVCGKVFHHISHLAQHQRIHTGEKPYKCNECGKVFSHKSSLVNHWRIHTGEKPYKCNECGKVFSHKSSLVNHWRIHTGEKPYKCNECGKVFSRNSYLAQHLIIHAGEKPYKCDECDKAFSQNSHLVQHHRIHTGEKPYKCDECGKVFSQNSYLAYHWRIHTGEKAYKCNECGKVFGLNSSLAHHRKIHTGEKPFKCNECGKAFSMRSSLTNHHAIHTGEKHFKCNECGKLFRDNSYLVRHQRFHAGKKSNTCN

SEQ ID NO: 33865 - protein, 17 aa, Homo sapiens
KPRHTRFLLQRNPEKCT

SEQ ID NO: 33866 - protein, 8 aa, Homo sapiens
KRHAWEKG

SEQ ID NO: 33867 - protein, 77 aa, Homo sapiens
MKPSSSSTHFLLDPMPRNMESFKHKCQPDIYFFYNCQYSSSSSSQHLKPGLSHLYYSWSESVPGLLPQLQLWSHRSD

SEQ ID NO: 33868 - protein, 25 aa, Homo sapiens
ACTCSTETFLWRPFYKSIFVPDYTK

SEQ ID NO: 33869 - protein, 8 aa, Homo sapiens
QEPGQEES

SEQ ID NO: 33870 - protein, 10 aa, Homo sapiens
IRTGISVGLG

SEQ ID NO: 33871 - protein, 35 aa, Homo sapiens
LHLQHRDFPLETLLQVHLCPRLHQVKILMISPGKT

SEQ ID NO: 33872 - protein, 10 aa, Homo sapiens
MRDTYFSLMA

SEQ ID NO: 33873 - protein, 11 aa, Homo sapiens
VNLHVGFIVSK

SEQ ID NO: 33874 - protein, 22 aa, Homo sapiens
TRFRRILMVGREKTLDSVVMNL

SEQ ID NO: 33875 - protein, 14 aa, Homo sapiens
IYNGRNSYTCRSQT

SEQ ID NO: 33876 - protein, 10 aa, Homo sapiens
MPVLETTPST

SEQ ID NO: 33877 - protein, 24 aa, Homo sapiens
MSLCYMTLKIFRHPRIPLCIKLAC

SEQ ID NO: 33878 - protein, 21 aa, Homo sapiens
MDHCQMVWKTLLLLLYFNPVK

SEQ ID NO: 33879 - protein, 16 aa, Homo sapiens
KQSRISCDQTRPDFCL

SEQ ID NO: 33880 - protein, 25 aa, Homo sapiens
IRTQQRILRKKDLCFLQKITLKTAY

SEQ ID NO: 33881 - protein, 21 aa, Homo sapiens
VCSSTQLVSIPIFQPRYSKTR

SEQ ID NO: 33882 - protein, 14 aa, Homo sapiens
ITSNQRKSWWQQIL

SEQ ID NO: 33883 - protein, 40 aa, Homo sapiens
MAGLPRRSCPRAARRYARRRHPLNHVGRTQRSAMQLSVSP

SEQ ID NO: 33884 - protein, 868 aa, Homo sapiens
VLFYTACLDPNFPATLFKDKMKCTVNNQQSKKIMVAADIVTIFNLIQMNGGAAKEKLPTGRQKVRKKEASFESCRSDTEICNAAECEPLNCELSERSFSRGYPIRQSSKCRKMDCKDCPQFVPASEPNFLLGVSKEVKNRAASLDRLQALAPYSVTSPQPCEMQRTYFPMNIENESISDQDSLPINQSIKETFISNEEPFVVQSCVQKRNIFKEDFHNLMAVSPSLVGPISKAENEHREPQSRKEPHKPPFFNHSFEMPYNSQYLNPVYSPVPDKRRAKHESLDDLQASTYFGPTPVMGTQEARRCLGKPNKQTPWPAKSWSLNTEEVPDFERSFFNRNPSEEKLHYPNASSQTPNFPAPERRPTYLVPKDQQPILPIAYAAKQNGLKSKEISSPVDLEKHEPVKKFKDKSINCTSGQLSSDTSSVGTQTEHVLEPKKCRDLCTSGQGKYSDRHTMKHSDDDSEIVSDDISDIFRFLDDMSISGSTGVIQSSCYNSTGSLSQLHKSDCDSSPEHNLTKIANGVPNSKGDKGNRPENTHHSEEELKTSVCKLVLRIGEIERKLESLSGVRDEISQVLGKLNKLDQKMQQPEKVSVQIDLNSLTSEGPSDDSASPRMFHAHSGSHGPKLENNPDWCCSDASGSNSESLRVKALKKSLFTRPSSRSLTEENSATESKIASISNSPRDWRTITYTNRVGLNEEEIKDTGPGDNKDWHRKSKEADRQYDIPPQHRLPKQPKDGFLVEQVFSPHPYPASLKAHMKSNPLYTDMRLTELAEVKRGQPSWTIEEYARNAGDKGKLTALDLQTQESLNPNNLEYWMEDIYTPGYDSLLKRKEAEFRRAKVCKIAALIAAAACTVILVIVVPICTMKS

SEQ ID NO: 33885 - protein, 30 aa, Homo sapiens
MPRLLVSLKTRKICCQSLDNSYQMPTAPCF

SEQ ID NO: 33886 - protein, 66 aa, Homo sapiens
QSRWERPHPCRTINLWSLIMPSTMLIRSRTDFRANQTSTKHSWRFCTHIRKSREMPRKLEETTLQH

SEQ ID NO: 33887 - protein, 13 aa, Homo sapiens
IRDGHHESEIWTI

SEQ ID NO: 33888 - protein, 3192 aa, Homo sapiens
ADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIKVPHRPSLSSLETLMVSQKSEIEYLQEKLKIANEKLSENISANKGFSRKSIMTSAEGKHKEPPVKRSRSLSPKSSFTDSEELQKLRKAERKIENLEKALQLKSQENDELRDAHEKRKERLQMLQTNYRAVKEQLKQWEEGSGMTEIRKIKRADPQQLRQEDSDAVWNELAYFKRENQELMIQKMNLEEELDELKVHISIDKAAIQELNRCVAERREEQLFRSGEDDEVKRSTPEKNGKEMLEQTLQKVTELENRLKSFEKRSRKLKEGNKKLMKENDFLKSLLKQQQEDTETREKELEQIIKGSKDVEKENTELQVKISELETEVTSLRRQVAEANALRNENEELINPMEKSHQSADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIKVPHRPSLSSLETLMVSQKSEIEYLQEKLKIANEKLSENISANKGFSRKSIMTSAEGKHKEPPVKRSRSLSPKSSFTDSEELQKLRKAERKIENLEKALQLKSQENDELRDAHEKRKERLQMLQTNYRAVKEQLKQWEEGSGMTEIRKIKRADPQQLRQEDSDAVWNELAYFKRENQELMIQKMNLEEELDELKVHISIDKAAIQELNRCVAERREEQLFRSGEDDEVKRSTPEKNGKEMLEQTLQKVTELENRLKSFEKRSRKLKEGNKKLMKENDFLKSLLKQQQEDTETREKELEQIIKGSKDVEKENTELQVKISELETEVTSLRRQVAEANALRNENEELINPMEKSHQSADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIKVPHRPSLSSLETLMVSQKSEIEYLQEKLKIANEKLSENISANKGFSRKSIMTSAEGKHKEPPVKRSRSLSPKSSFTDSEELQKLRKAERKIENLEKALQLKSQENDELRDAHEKRKERLQMLQTNYRAVKEQLKQWEEGSGMTEIRKIKRADPQQLRQEDSDAVWNELAYFKRENQELMIQKMNLEEELDELKVHISIDKAAIQELNRCVAERREEQLFRSGEDDEVKRSTPEKNGKEMLEQTLQKVTELENRLKSFEKRSRKLKEGNKKLMKENDFLKSLLKQQQEDTETREKELEQIIKGSKDVEKENTELQVKISELETEVTSLRRQVAEANALRNENEELINPMEKSHQSADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIKVPHRPSLSSLETLMVSQKSEIEYLQEKLKIANEKLSENISANKGFSRKSIMTSAEGKHKEPPVKRSRSLSPKSSFTDSEELQKLRKAERKIENLEKALQLKSQENDELRDAHEKRKERLQMLQTNYRAVKEQLKQWEEGSGMTEIRKIKRADPQQLRQEDSDAVWNELAYFKRENQELMIQKMNLEEELDELKVHISIDKAAIQELNRCVAERREEQLFRSGEDDEVKRSTPEKNGKEMLEQTLQKVTELENRLKSFEKRSRKLKEGNKKLMKENDFLKSLLKQQQEDTETREKELEQIIKGSKDVEKENTELQVKISELETEVTSLRRQVAEANALRNENEELINPMEKSHQSADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIKVPHRPSLSSLETLMVSQKSEIEYLQEKLKIANEKLSENISANKGFSRKSIMTSAEGKHKEPPVKRSRSLSPKSSFTDSEELQKLRKAERKIENLEKALQLKSQENDELRDAHEKRKERLQMLQTNYRAVKEQLKQWEEGSGMTEIRKIKRADPQQLRQEDSDAVWNELAYFKRENQELMIQKMNLEEELDELKVHISIDKAAIQELNRCVAERREEQLFRSGEDDEVKRSTPEKNGKEMLEQTLQKVTELENRLKSFEKRSRKLKEGNKKLMKENDFLKSLLKQQQEDTETREKELEQIIKGSKDVEKENTELQVKISELETEVTSLRRQVAEANALRNENEELINPMEKSHQSADRAKSEMATMKVRSGRYDCKTTMTKVKFKAAKKNCSVGRHHTVLNHSIKVMSNVFENLSKDGWEDVSESSSDSEAQTSQTLGTIIVETSQKISPTEDGKDQKESDPTEDSQTQGKEIVQTYLNIDGKTPKDYFHDKNAKKPTFQKKNCKMQKSSHTAVPTRVNREKYKNITAQKSSSNIILLRERIISLQQQNSVLQNAKKTAELSVKEYKEVNEKLLHQQQVSDQRFQTSRQTIK

SEQ ID NO: 33889 - protein, 14 aa, Homo sapiens
AMCLRTSARTAGRM

SEQ ID NO: 33890 - protein, 31 aa, Homo sapiens
MNNSMVNCQMDDIKFPSHSSQSFPPRCSLDP

SEQ ID NO: 33891 - protein, 32 aa, Homo sapiens
MKMSSKSLSTITSGPSSRPSCFSSVLWGFCCL

SEQ ID NO: 33892 - protein, 125 aa, Homo sapiens
INLSFLRLFRAARLIKLLRQGYTIRILLWTFVQSFKALPYVCLLIAMLFFIYAIIGMQVFGNIGIDVEDEDSDEDEFQITEHNNFRTFFQALMLLFRSMGLLLLMKMPCGCSTSSSPPSSLWNVC

SEQ ID NO: 33893 - protein, 40 aa, Homo sapiens
AFSASSELPGSSNFSVRVTPSAFFSGPLCSPSRPCLMSVC

SEQ ID NO: 33894 - protein, 60 aa, Homo sapiens
QPELSPPLPSCPAHQTSPSGLHHPHSSLDLCAVLQGPALCLSADRHALLHLCHHWDAGVW

SEQ ID NO: 33895 - protein, 44 aa, Homo sapiens
MDLPVADDNTVHFNSTLMALIRTALDIKIAKDAESLCRRHHGQL

SEQ ID NO: 33896 - protein, 27 aa, Homo sapiens
MALIRTALDIKIAKDAESLCRRHHGQL

SEQ ID NO: 33897 - protein, 25 aa, Homo sapiens
QHRPLQFHPHGSDPHSPGHQDCQGC

SEQ ID NO: 33898 - protein, 137 aa, Homo sapiens
MVQAIKWVDEVVPAAPYVTTLETLDKYNCDFCVHGNDITLTVDGRDTYEEVKQAGRYSYDMVHYGHSNQLRQARAMGDYLIVGVHTDAKEKGHLLPTTASEAPKPSGAEHLLVRRNLCLCLRPSQGREPPSWPALVG

SEQ ID NO: 33899 - protein, 39 aa, Homo sapiens
RRSPSTRGPRCSLRRRDTRWCRPSNGWTRWCQRLPTSLH

SEQ ID NO: 33900 - protein, 27 aa, Homo sapiens
MRMMKTWRMNQFTPAITVSRTSSLWQT

SEQ ID NO: 33901 - protein, 19 aa, Homo sapiens
KESQSAIRKPAVRWKTGTA

SEQ ID NO: 33902 - protein, 328 aa, Homo sapiens
MAAVTRDFGEMLLHSGRVLPAEAQPWGAPVEVESFLVHPGDLLQLRCRLRDDVQSINWLRDGVQLAESNRTRITGEEVEVQDSVPADSGLYACVTSSPSGSDTTYFSVNVSDALPSSEDDDDDDDSSSEEKETDNTKPNRMPVAPYWTSPEKMEKKLHAVPAAKTVKFKCPSSGTPNPTLRWLKNGKEFKPDHRIGGYKVRYATWSIIMDSVVPSDKGNYTCIVENEYGSINHTYQLDVVERSPHRPILQAGLPANKTVALGSNVEFMCKVYSDPQPHIQWLKHIEVNGSKIGPDNLPYVQILKGQFEKEDRAHCGVSMEMWSLVTNL

SEQ ID NO: 33903 - protein, 36 aa, Homo sapiens
MITLSVLHIPLWAHFMDSLCVLVKCAVLLPRPCKAY

SEQ ID NO: 33904 - protein, 34 aa, Homo sapiens
VSSTFLCGLTSWTHFACLLNVLCCSQDHVKPTDH

SEQ ID NO: 33905 - protein, 24 aa, Homo sapiens
MNDYTKCPPHSSVGSLHGLTLRAC

SEQ ID NO: 33906 - protein, 9 aa, Homo sapiens
MCCVAPKTM

SEQ ID NO: 33907 - protein, 1049 aa, Homo sapiens
MGNSDSQYTLQGSKNHSNTITGAKQIPCSLKIRGIHAKEEKSLHGWGHGSNGAGYKSRSLARSCLSHFKSNQPYASRLGGPTCKVSRGVAYSTHRTNAPGKDFQGISAAFSTENGFHSVGHELADNHITSRDCNGHLLNCYGRNESIASTPPGEDRKSPRVLIKTLGKLDGCLRVEFHNGGNPSKVPAEDCSEPVQLLRYSPTLASETSPVPEARRGSSADSLPSHRPSPTDSRLRSSKGSSLSSESSWYDSPWGNAGELSEAEGSFLAPGMPDPSLHASFPPGDAKKPFNQSSSLSSLRELYKDANLGSLSPSGIRLSDEYMGTHASLSNRVSFASDIDVPSRVAHGDPIQYSSFTLPCRKPKAFVEDTAKKDSLKARMRRISDWTGSLSRKKRKLQEPRSKEGSDYFDSRSDGLNTDVQGSSQASAFLWSGGSTQILSQRSESTHAIGSDPLRQNIYENFMRELEMSRTNTENIETSTETAESSSESLSSLEQLDLLFEKEQGVVRKAGWLFFKPLVTVQKERKLELVARRKWKQYWVTLKGCTLLFYETYGKNSMDQSSAPRCALFAEDSIVQSVPEHPKKENVFCLSNSFGDVYLFQATSQTDLENWVTAVHSACASLFAKKHGKEDTLRLLKNQTKNLLQKIDMDSKMKKMAELQLSVVSDPKNRKAIENQIQQWEQNLEKFHMDLFRMRCYLASLQGGELPNPKSLLAAASRPSKLALGRLGILSVSSFHALVCSRDDSALRKRTLSLTQRGRNKKGIFSSLKGLDTLARKGKEKRPSITQIFDSSGSHGFSGTQLPQNSSNSSEVDELLHIYGSTVDGVPRDNAWEIQTYVHFQDNHGVTVGIKPEHRVEDILTLACKMRQLEPSHYGLQLRKLVDDNVEYCIPAPYEYMQQQVYDEIEVFPLNVYDVQLTKTGSVCDFGFAVTAQVDERQHLSRIFISDVLPDGLAYGEGLRKGNEIMTLNGEAVSDLDLKQMEALFSEKSVGLTLIARPPDTKATLCTSWSDSDLFSRDQKSLLPPPNQSQLLEEFLDNFKKNTANGLCV

SEQ ID NO: 33908 - protein, 25 aa, Homo sapiens
MCRARCFWRHASHTLHGKLGRWTYY

SEQ ID NO: 33909 - protein, 64 aa, Homo sapiens
ASRPAPSRPVWPGRRGNAVLAAATRTACPGAPAPCPAPSHDPAPLTPPAPSAAAAAAQCGGVPG

SEQ ID NO: 33910 - protein, 17 aa, Homo sapiens
ILRSILKTLHGQRIVMM

SEQ ID NO: 33911 - protein, 159 aa, Homo sapiens
MAQHDFAPAWLNFPTPPSSTKVLTSSLKSSLNFEKHSENFAWTENRYDVNRRRHNSSDGFDSAIGRPNGGNFGRKEKNGWRTHGRNGTENINHRGGYHGGSSRSRSSIFHAGKSQGLHENNIPDNETGRKEDKRERKQFEAEDFNYAAGQGMDAGREKR

SEQ ID NO: 33912 - protein, 11 aa, Homo sapiens
KILTVSCNRLK

SEQ ID NO: 33913 - protein, 10 aa, Homo sapiens
ILTVSCNRLK

SEQ ID NO: 33914 - protein, 9 aa, Homo sapiens
KILTVSCNR

SEQ ID NO: 33915 - protein, 9 aa, Homo sapiens
LTVSCNRLK

SEQ ID NO: 33916 - protein, 10 aa, Homo sapiens
IRTGISVGLG

SEQ ID NO: 33917 - protein, 9 aa, Homo sapiens
KILTVSRLK

SEQ ID NO: 33918 - protein, 9 aa, Homo sapiens
KILTVSNRL

SEQ ID NO: 33919 - protein, 10 aa, Homo sapiens
KILTVSCNRL

SEQ ID NO: 33920 - protein, 9 aa, Homo sapiens
KTVSCNRLK

SEQ ID NO: 33921 - protein, 9 aa, Homo sapiens
ILVSCNRLK

SEQ ID NO: 33922 - protein, 9 aa, Homo sapiens
ILTVSNRLK

SEQ ID NO: 33923 - protein, 9 aa, Homo sapiens
ILTVSCNRL

SEQ ID NO: 33924 - protein, 9 aa, Homo sapiens
IRTGISVGL

SEQ ID NO: 33925 - DNA, 174 bp, synthetic construct
  source 1..174: mol_type = other DNA
agactcgggaactgcctgaatgtggtttgggacacgagacctcatcatattgatgagcgaacaaacaagaacatttcctccctcccctcctttgaattgaaatggcacattaagacttgtcacggcttctcactgggactggagacctcgttccttcaccccgcgtgtcgccag

SEQ ID NO: 33926 - DNA, 174 bp, synthetic construct
  source 1..174: mol_type = other DNA
atttatgatttcaacatggatacatatttcagttctttctttttctcactatctgaaaatacatttccctccctctcttccccccaatatctccctttttttctctcttcctctatcttccaaaccccactttctccctcctccttttcctgtgttctcttaagcagatagcac

SEQ ID NO: 33927 - DNA, 174 bp, synthetic construct
  source 1..174: mol_type = other DNA
agactcgggaactgcctgaatgtggtttgggacacgttctttttctcactatctgaaaatacaaacaagaacatttcctccctcccctcctttgaattgaaatggcacattaagacttgtcacggcttctcactgggactggagacctcgttccttcaccccgcgtgtcgccag

SEQ ID NO: 33928 - DNA, 174 bp, synthetic construct
  source 1..174: mol_type = other DNA
agactcgggaactgcctgaatgtggtttgggacacgttctttttctcactatctgaaaatacaaagacctcatcatattgatgagcgaactttgaattgaaatggcacattaagacttgtcacggcttctcactgggactggagacctcgttccttcaccccgcgtgtcgccag

SEQ ID NO: 33929 - DNA, 174 bp, synthetic construct
  source 1..174: mol_type = other DNA
agactcgggaactgcctgaatgtggtttgggacacgagacgagtagttattgatgagcgaacaaacaagaacatttcctccctcccctcctttgaattgaaatggcacattaagacttgtcacggcttctcactgggactggagacctcgttccttcaccccgcgtgtcgccag

SEQ ID NO: 33930 - DNA, 174 bp, synthetic construct
  source 1..174: mol_type = other DNA
agactcgggaactgcctgaatgtggtttgggacacgagacgagtagttatactactccgaacaaacaagaacatttcctccctcccctcctttgaattgaaatggcacattaagacttgtcacggcttctcactgggactggagacctcgttccttcaccccgcgtgtcgccag

SEQ ID NO: 33931 - DNA, 174 bp, synthetic construct
  source 1..174: mol_type = other DNA
agactcgggaactgcctgaatgtggtttgggacacgagagggccctgaagaagggcccgaacaaacaagaacatttcctccctcccctcctttgaattgaaatggcacattaagacttgtcacggcttctcactgggactggagacctcgttccttcaccccgcgtgtcgccag

SEQ ID NO: 33932 - DNA, 174 bp, synthetic construct
  source 1..174: mol_type = other DNA
atttatgatttcaacatggatacatatttcagttctagacctcatcatattgatgagcgaacatttccctccctctcttccccccaatatctccctttttttctctcttcctctatcttccaaaccccactttctccctcctccttttcctgtgttctcttaagcagatagcac

SEQ ID NO: 33933 - protein, 20 aa, Homo sapiens
QVYTSGKGSSAAGLTASVMR

SEQ ID NO: 33934 - protein, 18 aa, Homo sapiens
IFTPAVSAVYSTVTQVAR

SEQ ID NO: 33935 - protein, 40 aa, synthetic construct
CTTATGTCCAGATCTTGAAGGGTCAGTTTGAAAAGGAGGA

SEQ ID NO: 33936 - protein, 8 aa, Homo sapiens
GQFEKEDR

SEQ ID NO: 33937 - protein, 16 aa, Homo sapiens
AHCGVSMEMWSLVTNL

SEQ ID NO: 33938 - DNA, 174 bp, synthetic construct
  source 1..174: mol_type = other DNA
agtacagggcagtcgtcaacagttcaacacgcagaataggtttgcgtcttgatatgctgtgtggacgagggcatgcccacggtacatcttaacctatccgggggtcggataggcgaaagtccagtattggactgggagtacagcctgatagggtgttgcagagacccatctgat

SEQ ID NO: 33939 - DNA, 174 bp, synthetic construct
  source 1..174: mol_type = other DNA
tggttgaatgagatgcaaaaaattaggaaggacattgacctgtggaaaccttcagcaggtcattgcaactgggaggaagtagagttctgttccaaccactttcacaagcttgttatgagagatgggagaaccttggttgttccttgcagacatgaagttgagcttgtggggcgt

SEQ ID NO: 33940 - DNA, 174 bp, synthetic construct
  source 1..174: mol_type = other DNA
agtgaaaacgttcctgctctcacagatcacgggacgctaccgctgcgcaacagcatcggaggagtccagcgagtgaccattactgacgccagacgccgcacctgcccctacgtttacaaggccctgggcatagtctcgccgcgcgtcctatcgagccgcactttttgagcaaac

SEQ ID NO: 33941 - DNA, 174 bp, synthetic construct
  source 1..174: mol_type = other DNA
gttgacataatatgataatgtgacaattatgagactgttttaaaccttaagacctgatgcctcagttgtaacttttttttttttttctgagacggtgtcctgctctgtcacccaggctggagtgcagtggcgcgatctctgctcactgcaacgtccgcctcccgggttcaagca

SEQ ID NO: 33942 - DNA, 174 bp, synthetic construct
  source 1..174: mol_type = other DNA
tcgttaatgcccttgaagtggtttttgtgggtgtgaaacaaatggtgagaatttgaattggtccctcctattatagtattgaaattaagtctacttaatttatcaagtcatgttcatgccctgattttatatacttgtatctatcaataaacattgtgatacttgatgtagtga

SEQ ID NO: 33943 - DNA, 174 bp, synthetic construct
  source 1..174: mol_type = other DNA
ggctgactggggacctgtcccacctggcggccatcgtcatcctgctgctgaagatctggaagacgcgctcctgcgccggtatttctgggaaaagccagcttctgtttgcactggtcttcacaactcgttacctggatctttttacttcatttatttcattgtataacacatcta

SEQ ID NO: 33944-33945 - skipped (2 entries)

SEQ ID NO: 33946 - DNA, 174 bp, synthetic construct
  source 1..174: mol_type = other DNA
catcctcctgctgaagtgacaagccacgctgcttctggagccaaagctgaccaagaagaacaaatccaccccagatctagactcaggtcacctcctgaagccctcgttcagggtcgatatccccacatcaaggacggtgaggatcttaaagaccactcaacagaaagtaaaaaa

SEQ ID NO: 33947 - DNA, 174 bp, synthetic construct
  source 1..174: mol_type = other DNA
gcagaagggaaacgtgaagaaggtgaagatggcggtggccagggccggggtcttgggagtccagtggctgcaaagggcatcccggaacgtgatgccgctgggcgcacggacagcctcccacatgaccaaggacatgttcccggggccctatcctaggaccccagaagaacgggc

SEQ ID NO: 33948 - DNA, 174 bp, synthetic construct; identical to SEQ ID NO: 33925
  source 1..174: mol_type = other DNA

SEQ ID NO: 33949 - DNA, 174 bp, synthetic construct
  source 1..174: mol_type = other DNA
aggtgggcggtggcggtaggtgggtggccagcgactggcaacgcggtggcttagacgcgcgagatccggccagggtcagagtactgtaagattgatgttaaaggcatggtgttcaccccacttcatcagcgtacataagttatctcttcttttggacccttattttatgccata

SEQ ID NO: 33950 - DNA, 174 bp, synthetic construct
  source 1..174: mol_type = other DNA
ggaggcaggttgatgtgtttgtgcttccttctacagccaatatgaaaaggcctagtaagtggggtcgggaggcgggcgtggagggacccacgtctggaagttgctgcagccaccacgacgctcttctacggctacggctttgtctctgctgagttaaagaaagcaagtaaacgc

SEQ ID NO: 33951 - DNA, 174 bp, synthetic construct
  source 1..174: mol_type = other DNA
atttataagcaatagtagcttatttggctcacagttctggaggctgagaagatcgtgaggctgcatctggcaagggccttcttgctgcttcataacatggcagaagacatcatgcgggtgtgtgtctggggaagagacttacagaagtggagttgctgagtcaaagatctaacc

SEQ ID NO: 33952 - DNA, 174 bp, synthetic construct
  source 1..174: mol_type = other DNA
tcttttggtgcagaaggtgacgggaaacaggccgcagacctgaacttccaaccgtatgtaggcgagaagccggtgccgatactcccactatcccacaatgtcccactgggccccagagtggaagagggcggaggctaatccaagagaccttggggccagctgggatgtcagggg

SEQ ID NO: 33953 - DNA, 174 bp, synthetic construct
  source 1..174: mol_type = other DNA
atccaccatgaagcagaatctaaagaaaaaggtccaagcatgaaggaaccaaatccaatttctccaccaattttccatggtctggacaccctaaccgtgatgggcattgcgtttgcagcctttgtgatcggagcactcctgacgggggccttgtggtacatctattctcacaca

SEQ ID NO: 33954 - DNA, 174 bp, synthetic construct
  source 1..174: mol_type = other DNA
cagattagaggacgggcgctttggagccggccccaggcagcgtgtgtcggtcgcctagtctggagaactagtcctcgactcacgtgcaaggatgatgctgaaaggaataacaaggcttatctctaggatccataaggccaagcatggggatcagcacgagggtcagcactacaa

SEQ ID NO: 33955 - DNA, 174 bp, synthetic construct
  source 1..174: mol_type = other DNA
ctctcgggggccaggggtcatcggtttgacccctgacctataagccaagataccccataaacacactcagaaagcagagaaaaaggacaagagtctgtgtttgagagggggtctgccattcctgcttggggactggtggggaagagggccaggacatcttctgagccaggacgt

SEQ ID NO: 33956 - DNA, 174 bp, synthetic construct
  source 1..174: mol_type = other DNA
agtctggctgcggcggcagagctgaagtgagcggagccaccaggaggccatgtcgggtgaggacgctgaggtccgggcagtctctgaagatgtctccaatggaagcagtggctcgcccagccctggggacacactgccctggaaccttgggaaaacgcagcggagccggcgcag

SEQ ID NO: 33957 - DNA, 174 bp, synthetic construct
  source 1..174: mol_type = other DNA
atctgcctcagcctctttgtcactgcctggaccattgtccctgctgtttctcagacagcatagaggctgaggctggggccaggacccagacagagacacacggtcactgcagctgaagccgctgcccctgctacaggcaccaccaggaccagctgatcattccagcccacagca

SEQ ID NO: 33958 - DNA, 174 bp, synthetic construct
  source 1..174: mol_type = other DNA
ctcaggctgtggccccacctgcccccaagcccacccaggctggggaaggaacgctgtcagaggccctgctgcagctgcagtttgatgatgaagacctgggggccttgcttggcaacagcacagacccagctgtgttcacagacctggcatccgtcgacaactccgagtttcagc

SEQ ID NO: 33959 - DNA, 174 bp, synthetic construct
  source 1..174: mol_type = other DNA
ctcaaggttttgaagagacaggggacacgctctatgccccctattccacacattttcagctgcagaaccagcctccccaaaaggaattctccatcccacgggcccacgcttggccgagcccttacaaagactatgaagtaaagaaagagggcagctaactctgtcctgaagagt

SEQ ID NO: 33960 - DNA, 174 bp, synthetic construct
  source 1..174: mol_type = other DNA
gcttccgtagaggccagctggttgctacgcagcaacaggaaacattccgcgctaccgagtactttctactcccgaccaggcattgctctctctggagaccctcggcggtggttgctgtattttgacttggagtaaggatgacttttcgggccacagatagtgaatttgacctga

SEQ ID NO: 33961 - DNA, 174 bp, synthetic construct
  source 1..174: mol_type = other DNA
ctggagggccgcactcccgttccagccaggctgagccttctgtcccctgcctctggggcctgggaaccccccttcttctttctcctgaatggcacccccgccctagaatccagacaccgagtttcccactgtggctggttcaaggagctccctggtgacagtctgtggctgagc

SEQ ID NO: 33962 - DNA, 174 bp, synthetic construct
  source 1..174: mol_type = other DNA
tagagtggggggtggaagatgattctcgcctgttgctggggatttatgaacatggctatggaaactgggagttaattaaaacagacccagagcttaaattaactgacaaaattctgccggtggagacagataaaaagcctcaggggaagcagctacagacccgagcggattact

SEQ ID NO: 33963 - DNA, 174 bp, synthetic construct
  source 1..174: mol_type = other DNA
agcggctgcagcatccagccagcttggatgtctggcctgtgagcctggggaaactattattaataatatttactgttgataatattggggaaaacagcccttaactctgaggtttctgctgtgctcctttccaaaacagacttccaggactctgaagaaacagttacaagcagg

SEQ ID NO: 33964 - DNA, 174 bp, synthetic construct
  source 1..174: mol_type = other DNA
aagggaggaggcgccgagctgaccgggcgacgccgcgggaggttctggaaacgccgggagctgcgagtgtccagacacttccctctgtgaccatgaaactctgggtgtctgcattgctgatggcctggtttggtgtcctgagctgtgtgcaggccgaattcttcacctctattg

SEQ ID NO: 33965 - DNA, 174 bp, synthetic construct
  source 1..174: mol_type = other DNA
gcgaactgaaggtggcccaagggaaggctctgcaagagaatttggccctcctgacccagaccctagctgaaagagaagaggaggtggagactctgcggggacaaatccaggaactggagaagcaacgggaaatgcagaaggctgctttggaattgctgtctctggacctgaaga

SEQ ID NO: 33966 - DNA, 174 bp, synthetic construct
  source 1..174: mol_type = other DNA
aggaagccgaggaaggctgtgtttctgactcacacgggggagtcgggggagtcgtaaacaaccctgaagagaacagccaggcctggcgctctgggcttggtcctgggacacccgtttgacactgtaaaggtgaggctgcagacccagaccacctaccggggcatcgttgattgc

SEQ ID NO: 33967 - DNA, 174 bp, synthetic construct
  source 1..174: mol_type = other DNA
ctgcctcccccccgctcccgctcccctgagcccagccagaccccgcgccgcccgcgccccgctcgactccggaggctcccgcagccccggcgtccgccccgctgccccctcccccgggggccatgggggcgcccccgggctaccggccctcagcttgggtgcatctcctccacc

SEQ ID NO: 33968 - DNA, 174 bp, synthetic construct
  source 1..174: mol_type = other DNA
ctcagtgaagcaacgaggatgccggggagagggaaggggctgggctctgggcggtgccaagtctgtgagggggcgcggtcaccgcccagggttcccacgaacgccaaggcggccacgtcctgctccccctggtgaagaagctgccctgggcttgtcgtcctagggtctccagac

SEQ ID NO: 33969 - DNA, 174 bp, synthetic construct
  source 1..174: mol_type = other DNA
ctgatgtgagctagtttgtctggttgagttggatgtttaaatagaaggcagaacaacaacaggtactccacatcagcattctcaagactggagaagttaggcctcagacatcccaagccttctcctttcattggaaacttgacatttttccgccagggtttttgggaaagccaa

SEQ ID NO: 33970 - DNA, 174 bp, synthetic construct
  source 1..174: mol_type = other DNA
gccacattccacactaacgtgttggtgaattcttctgggcattgccagtacctgcctccaggcatattcaagagttcctgctacatcgatgtacgctggtttccctttgatgtgcagcactgcaaactgaagtttgggtcctggtcttacggaggctggtccttggatctgcag

SEQ ID NO: 33971 - DNA, 174 bp, synthetic construct
  source 1..174: mol_type = other DNA
tcctgcctcggcaaccccgggccctgagggcaggccccaaccgcggaggagcaggagagggcggaggccggcgggccatgccctggtcgtcccgcggcgccctccttcgggacctggtcctgggcgtgctgggcaccgccgccttcctgctcgacctgggcaccgacctgtggg

SEQ ID NO: 33972 - DNA, 174 bp, synthetic construct
  source 1..174: mol_type = other DNA
aagtttgaaactggtaacttcgggagttgagccacgagctgttgtgcatccagaggtggaattggggcccggcattccctcctcgtcccgggctggcccttgcccccaccctgcaactcctggttgagatgggctcagccaagagcgtcccagtcacaccagcgcggcctccgc

SEQ ID NO: 33973 - DNA, 174 bp, synthetic construct
  source 1..174: mol_type = other DNA
agccttcgctggatctccttcccgaactcacaaatcctgacgagctcctgtcttatctggacccccccgacctgccgagcaatagtaacgatgacctcctgtctctatttgagaacaactgagggccacccggtcggggccatccctccacactctgcatcctaccccacctac

SEQ ID NO: 33974 - DNA, 174 bp, synthetic construct
  source 1..174: mol_type = other DNA
tttttagaggttggttgttgtgttttaggattctgtccattttcttttaaagttataaacacgtacttgtgcgaattatttttttaaagtgatttgccatttttgaaagcgtatttaatgatagaatactatcgagccaacatgtactgacatggaaagatgtcaaagatatgt

SEQ ID NO: 33975 - DNA, 174 bp, synthetic construct
  source 1..174: mol_type = other DNA
agccagcggacgtccaggaaccgggatgcctccagcagtgaggcggtcagcctgcagcatgggatggctgtggatctttggggcagccctggggcagtgtctgggctacagttcacagcagcaaagggtgccatttcttcagcctcccggtcaaagtcaactgcaagcgagtta

SEQ ID NO: 33976 - DNA, 174 bp, synthetic construct
  source 1..174: mol_type = other DNA
gggaccaggaactggaggctctgcagcaagaacagcagcaggcccagggacaggaggagagggtgaaggaaaaggcagacgccctccagggagctctggagcaagcccatatgacactgaaggagcgtcatggagagcttcaggaccacaaggaacaggcacgaaggctggagg

SEQ ID NO: 33977 - DNA, 174 bp, synthetic construct
  source 1..174: mol_type = other DNA
ctactccggagcctgaggtgggaggatcgcttgagtctgggaggcagaggctgcattgagctatgatcatggcactgcattccagcctgggtgacagtgcaagaccttgtctcagaataaataaagtatgtgatgaagatgtgcatacattatatgcaaatactgttttttttt

SEQ ID NO: 33978 - DNA, 174 bp, synthetic construct
  source 1..174: mol_type = other DNA
caccaattcggctggcgtctccgagaccgcggactcccgtagggtccccgtggccccgagttgtagtcgggacaccccggccgcgggtgatcgtcgggtctccacgcgcccgggtcgctgacgcggatccggcctcggcgccttctcagggcgccctgcaaggccgcaggcagg

SEQ ID NO: 33979 - DNA, 174 bp, synthetic construct
  source 1..174: mol_type = other DNA
cctcctctctggctaatcaacagctgcccccagcctgtggtgccaggcaactcagcaagctgaaaaggttccttactaccctgcagcagtttggcaatgacatttcacccgagataggagaaagagttcgcaccctcgttctgggactagtgaactccactttgacaattgaag

SEQ ID NO: 33980 - DNA, 174 bp, synthetic construct
  source 1..174: mol_type = other DNA
tttagtgtcacaggagacacgagggcaaagtgctgaggaaactctagagcaacatcggaatgcatggtgaagcatcagatggtgaaggagaaggagacacagaagtgatgcagcaggagacagttccagttcctgtaccttcagagaaaaccaaacagcctaaagaatgttttt

SEQ ID NO: 33981 - DNA, 174 bp, synthetic construct
  source 1..174: mol_type = other DNA
gccacttctcttcccttcattcttcgccaggctctctgctgactcaagttcttcagttcacgatcttctagttgcagcgatgagtgcacgagtgagatcaagatccagaggaagaggagatggtcaggaggctcccgatgtggttgcattcgtggctcccggtgaatctcagca

SEQ ID NO: 33982 - DNA, 174 bp, synthetic construct
  source 1..174: mol_type = other DNA
cttcaacttggcaacagttgcctggggtagctctacacaactctgtccagcccacagcaatgattccagaggccatggggagtggacagcagctagctgactggaggaatgcccactctcatggcaaccagtacagcactatcatgcagcagccatccttgctgactaaccatg

SEQ ID NO: 33983 - DNA, 174 bp, synthetic construct
  source 1..174: mol_type = other DNA
caccctgacccaagccgagacaggttccaaacctcaacctgcagccggaagggggaagtgaaactcggctgggggtgggggctcagaagccgccccagaaagcactgaaagccacagcacgtacacccactccagggatctgccagcaccctgtggggcccagactacaggctg

SEQ ID NO: 33984 - DNA, 174 bp, synthetic construct
  source 1..174: mol_type = other DNA
gggacgccattgtgattggggcggggatccagggctgcttcactgcataccacctggccaaacacaggaagaggatcctcctgctggagcagttctttctaccacactcccgaggaagctcccatggacaaagccggataatccgaaaggcgtacctggaagacttttacaccc

SEQ ID NO: 33985 - DNA, 174 bp, synthetic construct
  source 1..174: mol_type = other DNA
caccgtagtgcttagaggccgaaaaagtacagccccttccgggctccgcggtacgggaagacagctttgggatgtcggaagatcctagaggtcccaaggtaccacgaaaggcagtggtagaaaagccagctcgggcagcagagcgagaggcccgggccctgctggagaagaacc

SEQ ID NO: 33986 - DNA, 174 bp, synthetic construct
  source 1..174: mol_type = other DNA
attggctgagcccggctgtcagtcctttcgcgcctcggcggcgcggcatagcccggctcggcctgtaaagcagtctcaagcctgccgcagggagaagatggcggtcgccgtgagaactttgcaggaacagctggaaaaggccaaagagagtcttaagaacgtggatgagaacat

SEQ ID NO: 33987 - DNA, 174 bp, synthetic construct
  source 1..174: mol_type = other DNA
acaaggagactgggaggtgtctcaagtgcctgtaccacacggaaggggaacactgtcagttctgccggtttggatactatggtgatgccctccagcaggactgtcgaaagtgtgtctgtaattacctgggcaccgtgcaagagcactgtaacggctctgactgccagtgcgaca

SEQ ID NO: 33988 - DNA, 174 bp, synthetic construct
  source 1..174: mol_type = other DNA
gaggaaggagagagtggaggaggagggctttgggttagggagagtgctttcgtttgttttaaatgggagaaactggagcatgttgccaagggcagagagccagcagagaggggtgaatggaagaaggagcgagaagggggttactgacgaagccttatcctggaggagagaagg

SEQ ID NO: 33989 - DNA, 174 bp, synthetic construct
  source 1..174: mol_type = other DNA
caagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcct

SEQ ID NO: 33990 - DNA, 174 bp, synthetic construct
  source 1..174: mol_type = other DNA
ctagaccaaagggtgcggctgctgcagaggtggctgatgcaggtttccatccttggggaatgaccacgcaactgggcccagccctggtgctgggggtggccctgtgcctgggttgtggccagcccctaccacaggtccctgaacgccccttctctgtgctgtggaatgtaccct

SEQ ID NO: 33991 - DNA, 174 bp, synthetic construct
  source 1..174: mol_type = other DNA
atctccagccattgctcctccaacagagaccatggctcctccagtcagggatcctgttcctgggaaacccacggtcaccatccggactcgaggcgccattattcaaaccccaaccctaggccccatccagcctactcgggtgtcagaagctggcaccacagttcctggccagat

SEQ ID NO: 33992 - DNA, 174 bp, synthetic construct
  source 1..174: mol_type = other DNA
ggaggcaggcggtgccgcggcgccgggacccgactcatccggtgcttgcgtgtggtggtgagcgcagcgccgaggatgaggaggtgcaacagcggctccgggccgccgccgtcgctgctgctgctgctgctgtggctgctcgcggttcccggcgctaacgcggccccgcggtcg

SEQ ID NO: 33993 - DNA, 174 bp, synthetic construct
  source 1..174: mol_type = other DNA
cacccccaccgacctctcggagacaggaatccgctctgcccctgcatcctcctctgctcacccttctctcagtagtgtttgtcagacaccagtccggacctcagctctcgatctagttcccgagtaagatttagctcccgggaaagcgtgcctgaaacaagccggagtgagcct

SEQ ID NO: 33994 - DNA, 174 bp, synthetic construct
  source 1..174: mol_type = other DNA
cctgtaccataaccaggaggctgatggttgctcaggcctccctcaaactagccaatgagaagtgcacgggtcctggtcgcctaggaaaccgcgtgacaacaagatggcggcgctgcgggacggctagcggccctgcgtgggagttcctgacagctggattctagaagtagaact

SEQ ID NO: 33995 - DNA, 174 bp, synthetic construct
  source 1..174: mol_type = other DNA
ttccccggaagtgttggttaaagcccctccaatcagcggctcggtgcggcaagtttgaatttcgtggaggctcgggttgtgagggttcctgcttcggagtcggcggtggtcgtccagaccgagtgttctttactttttgtttggttgaggtttcacgctagaaggtggctcagg

SEQ ID NO: 33996 - DNA, 174 bp, synthetic construct
  source 1..174: mol_type = other DNA
ctgtccatacactctctcatcatcctgttccttggattggacttcactaagcaatttatcactcaccttcagacttacatgtgggagttttcacaacagtagttttggaatcattagaacttggattgatttcatcatttaacagaaacaaacagcccaaattactttatcacc

SEQ ID NO: 33997 - DNA, 174 bp, synthetic construct
  source 1..174: mol_type = other DNA
gagctccagcctccaggcacccgggatccagcgccgccgctcataacacccgcgaccccgcagctaagcgcagctcccgacgcaatggacccggcgctggcagcccagatgagcgaggctgtggccgagaagatgctccagtaccggcgggacacagcaggctggaagatttgc

SEQ ID NO: 33998 - DNA, 174 bp, synthetic construct
  source 1..174: mol_type = other DNA
tgttgactcatgcaaatgaggtatctgaactgcagcttcagtattagcagagccacaggccgcctctgtggcatcaccagggtttctctgaagaagagggtctgcattttcctaaacccagtgctgctctcccatctcccatcttcctctcgcagcttgatgagccccggtgtg

SEQ ID NO: 33999 - DNA, 174 bp, synthetic construct
  source 1..174: mol_type = other DNA
tgccccagccctcagggccgccagcaaggaagaaatttgtgatacccctcgacgaggatgaggtccctcctggagtggccaagcccttattccgatctacacagagccttcccactgtggacacctcggcccaggcggcccctcagacctacgccgaatatgccatctcacagc

SEQ ID NO: 34000 - DNA, 174 bp, synthetic construct
  source 1..174: mol_type = other DNA
gagaggccggcgtctctcccccagtttgccgttcacccggagcgctcgggacttgccgatagtggtgacggcggcaacatgtctgtggctttcgcggccccgaggcagcgaggcaagggggagatcactcccgctgcgattcagaagatgttggatgacaataaccatcttatt

SEQ ID NO: 34001 - DNA, 174 bp, synthetic construct
  source 1..174: mol_type = other DNA
aaccccaaccctaggccccatccagcctactcgggtgtcagaagctggcaccacagttcctggccagattcgcccaacgatgaccattcctggctatgtggagcctactgcagttgctacccctcccacaaccaccaccaagaagccacgagtatccacaccaaaaccagcaac

SEQ ID NO: 34002 - DNA, 174 bp, synthetic construct
  source 1..174: mol_type = other DNA
ctgcagcatcttctacgtcgggaccacagcctccgcctccacaaagcctgaacctcctttcgcaggctcagctgcaggcacagcctcttgcgccaggcggaactcaaatgaaaaagaaaagtggcttccagataactagcgttactcctgctcagatctccgctagtatcagct

SEQ ID NO: 34003 - DNA, 174 bp, synthetic construct
  source 1..174: mol_type = other DNA
ccaatacctgggatccattgcctctccttctgtgcacccagcaacgcccatttcacctggacgtgccagcggcatgacaaccctctctgcagaactttccagtcgactctcaacggcacccgacctgacagcgttcagcgacccgcgccagttccccgcgctgccctccatctc

SEQ ID NO: 34004 - DNA, 174 bp, synthetic construct
  source 1..174: mol_type = other DNA
tctcttgcttcaacagtgtttggacggaacagatccggggactctcttccagcctccgaccgccctccgatttcctctccgcttgcaacctccgggaccatcttctcggccatctcctgcttctgggacctgccagcaccgtttttgtggttagctccttcttgccaaccaacc

SEQ ID NO: 34005 - DNA, 174 bp, synthetic construct
  source 1..174: mol_type = other DNA
agttacctctcccctttcacgtagttttcatttgtggtgagattctctcccaggccacaagacatttcctgctcggaaccttgtttactaatttccactgcttttaaggccctgcactgaaaatgcaagctcaggcgccggtggtcgttgtgacccaacctggagtcggtcccg

SEQ ID NO: 34006 - DNA, 174 bp, synthetic construct
  source 1..174: mol_type = other DNA
atcagcccaaaggtaggctcaggctccgacggtggccggcgggggtcacgaggcttcgtagtggaggaacgggtttggcgtgtgggacgcagctgcctctgtactggggagtcacggagtggccgggctccagggacatggcggcggcctctgcggtgtcggtgctgctggtgg

SEQ ID NO: 34007 - DNA, 174 bp, synthetic construct
  source 1..174: mol_type = other DNA
atccggaggcagcctgcaggaagccgtagcgccggtacgtgcccctctcctgtctggaggcgggtgtagaagtccgaccgcggaagccagactgctgtccagtcggcgagcgcgtaccattcagcatcggctccgcccgagtcccaccttcctcaggctctgattggctgacac

SEQ ID NO: 34008 - DNA, 174 bp, synthetic construct
  source 1..174: mol_type = other DNA
caacagaagccaagaaggaagccgtctatcttgtggcgatcatgtataagctggcctcctgctgtttgcttttcataggattcttaaatcctctcttatctcttcctctccttgactccagggaaatatcctttcaactctcagcacctcatgaagacgcgcgcttaactccgg

SEQ ID NO: 34009 - DNA, 174 bp, synthetic construct
  source 1..174: mol_type = other DNA
tggctgacacattcctggagcacatgtgccgcctggacattgattcaccacccatcacagcccggaacactggcatcatctgtaccattggcccagcttcccgatcagtggagctgaagaagggagccactctcaaaatcacgctggataacgcctacatggaaaagtgtgacg

SEQ ID NO: 34010 - DNA, 174 bp, synthetic construct
  source 1..174: mol_type = other DNA
gacatttacatcctgcccagcgacaactctggacaagtcagtcccccagagtctccaactgtgaccacttcctggcagtctgagagcttacctgtgtcactgtcagctagccagagttggcacacagaaagcctgccagtgtcactaggccctgagtcctggcagcagattgca

SEQ ID NO: 34011 - DNA, 174 bp, synthetic construct
  source 1..174: mol_type = other DNA
cctctgacttgacccaatgaaagaagcatatggcacttgtgaagataaatgttactcctccctttttaattggaacttctgcttaggacctgtgtatgacgtttcacctgtgatctgttctttcggtagccactgactttgagttacaggaaggtctccgaagatttgtgtcaa

SEQ ID NO: 34012 - DNA, 174 bp, synthetic construct
  source 1..174: mol_type = other DNA
cttccctgaggaggacgaccccaccaactggctgcgttgctactactacgaagacaccatcagcaccatcaagtctgtggcctgggagggaggggcctgtccagccttcctgccatccctacgaccactgcccctcacatcaccttctcatgggtccctctcccactccaaagc

SEQ ID NO: 34013 - DNA, 174 bp, synthetic construct; identical to SEQ ID NO: 33926
  source 1..174: mol_type = other DNA

SEQ ID NO: 34014 - DNA, 174 bp, synthetic construct
  source 1..174: mol_type = other DNA
cccttccggctggccccgctcagtcacccgcagcaggcgtgcagtttcccggctctccgcgcggccggggaaggtcagcgccgtaatggcgttcttggcgtcgggaccctacctgacccatcagcaaaaggtgttgcggctttataagcgggcgctacgccacctcgagtcgtg

SEQ ID NO: 34015 - DNA, 174 bp, synthetic construct
  source 1..174: mol_type = other DNA
atacaaatttgcctttggcacaacagataccactaagttctacccagttctccgcacaatcattagctcaggcaattggaagccaaattgaagatgccaggcgtgcagcggagccctccttagttggcttacctcagactatcagtggtgacagtgggggaatgtcagcagttt

SEQ ID NO: 34016 - DNA, 174 bp, synthetic construct
  source 1..174: mol_type = other DNA
tccgtcctccaggatctggggagaaagagccccatcccttctctctctgccaccatttcggacaccccgcagggactcgttttgggattcgcactgacttcaaggaaggacgcgaacccttctctgaccccagctcgggcggccacctgtctttgccgcggtgacccttctctc

SEQ ID NO: 34017 - DNA, 174 bp, synthetic construct
  source 1..174: mol_type = other DNA
gtttacttcccctgccagcattggggtgctctctaagcaacagtaggcggagagtggtctggcgtattaaaaacaaaggatcgtcaagtgggccttcccaggcattgctttgacttagtacatgtagaggatgtggcagttctctccgtccctgccactgctggtttctttgtt

SEQ ID NO: 34018 - DNA, 174 bp, synthetic construct
  source 1..174: mol_type = other DNA
tattttaagcccagtcttccctgggccacctttagcagatcctcgtgcgcccccgccccctggccgtgaaactcagcctctatccagcagcgacgacaagtaaagtggcccgccggtttctgagccttctgccctgcggggacacggtctgcaccctgcccgcggccacggacc

SEQ ID NO: 34019 - DNA, 174 bp, synthetic construct
  source 1..174: mol_type = other DNA
ccagcggaagtaattctttcgactgccccggaacccaccggagcaggcagctgggggtgggggggcggccctgggataggggctgtggcagtacgcggggacccggctgcggtggctgcgggactgacgaatggagaggagaaaacctatggtggctgtgaaggacctgatgcc

SEQ ID NO: 34020 - DNA, 174 bp, synthetic construct
  source 1..174: mol_type = other DNA
atggggaaggtgaaggtcggagtcaacggatttggtcgtattgggcgcctggtcaccagggctgcttttaactctggtaaagtggatattgttgccatcaatgaccccttcattgacctcaactacatggtttacatgttccaatatgattccacccatggcaaattccatggc

SEQ ID NO: 34021 - DNA, 174 bp, synthetic construct; identical to SEQ ID NO: 33967
  source 1..174: mol_type = other DNA

SEQ ID NO: 34022 - DNA, 174 bp, synthetic construct
  source 1..174: mol_type = other DNA
atttctgggaagcagtcgatattatctgtacgcctagaacagtgccctctgcagctgaataacccttttaacgagtattccaaatttgatggcaagggtcatgtaggtacaacagcaaccaagaagatcgatgtctacctccctctgcactcgagccaggacagactgctgcca

SEQ ID NO: 34023 - DNA, 174 bp, synthetic construct
  source 1..174: mol_type = other DNA
ctctggtgatacagaagaaaagacagtctccattttcaaacagtccctcctgggagaacacagacaggcagaggattacaacacaaggcagcaagcactgggagacgaaagttttggcatctgttccctggctgtgccaagatgggcgattggagcttcctgggaaatttcctg

SEQ ID NO: 34024 - DNA, 174 bp, synthetic construct
  source 1..174: mol_type = other DNA
gtctactatgtctgaactgtggtttcttgtttatccttttttccttagttggactgtaatgtatggtctgtcaacctgtgaatctttaaagtatgattcaggtattgttgtattctttactgtgtaataaaaaagttgaaaaaaatctggatcctctgtctccctcgtccccgg

SEQ ID NO: 34025 - DNA, 174 bp, synthetic construct
  source 1..174: mol_type = other DNA
tttcgtgaccttgtccagtagaaggctatttaattttcacaactgcttgaattttgacatacaagatgaagcaagatgcctcaagaaatgctgcctacactgtggattgtgaagattatgtgcatgtggtagaatttaatccctttgagaatggggattcaggaaacctaattg

SEQ ID NO: 34026 - DNA, 174 bp, synthetic construct
  source 1..174: mol_type = other DNA
tgtctgcaccagccggcctccagcctggctggaccctgctgcctgtgtggcccggagccagaggcccccacactcccagctgctcttctacagatgccatcaacgagcaggactctgggtggctccactgtctaagggctctgcgagtgacccggcgggcgagctccgtgctgc

SEQ ID NO: 34027 - DNA, 174 bp, synthetic construct
  source 1..174: mol_type = other DNA
cttacgtagtaattacatttccttgaaaaaactatagtgaatagaaatccctagccatttcattttttatgtttttaatgaagatctttaaaataccataggtggtaatcgtggaaaatttgaaaaatctcatgtcagtgtattaagatggtggagaagtttttttctccatta

SEQ ID NO: 34028 - DNA, 174 bp, synthetic construct
  source 1..174: mol_type = other DNA
attcatgaaaatccactactccagacagacggctttggaatccaccagctacatccagctccctgaggcagagttgagaatggagagaatgttacctctcctggctctggggctcttggcggctgggttctgccctgctgtcctctgccaccctaacagcccacttgacgagga

SEQ ID NO: 34029 - DNA, 174 bp, synthetic construct
  source 1..174: mol_type = other DNA
gagcttccagggatatttgaggcaccatccctgccattgccgggcactcgcggcgctgctaacggcctggtcacatgctctccggagagctacgggagggcgctgggtaacctctatccgagccgcggccgcgaggaggagggaaaaggcgagcaaaaaggaagagtgggagga

SEQ ID NO: 34030 - DNA, 174 bp, synthetic construct
  source 1..174: mol_type = other DNA
gccccctcccctgactatcaaagcagcggccggctgttggggtccaccacgccttccacctgccccactgcttcttcgcttctctcttggaaagtccagtctctcctcggcttgcaatggaccccaactgctcctgcgccgctggtgtctcctgcacctgcgctggttcctgca

SEQ ID NO: 34031 - DNA, 174 bp, synthetic construct
  source 1..174: mol_type = other DNA
agtcgcatagtggtttttccgctcgcgtcgctgtgtgaaagttggctcgccgctctttgcacgccctccctggaggccgacccgagacgccaagctggagagaccgtgcctccccgaggccggccgccccgcgagcacagcctccgcccccgttgcactgccgggctgggcaat

SEQ ID NO: 34032 - DNA, 174 bp, synthetic construct
  source 1..174: mol_type = other DNA
ggtggcgggaagaggaggcgcgagaatggaggtggaggccgtctgtggtggcgcgggcgaggtggaggcccaggactctgaccctgcccctgccttcagcaaggcccccggcagcgccggccactacgaactgccgtgggttgaaaaatataggccagtaaagctgaatgaaat

SEQ ID NO: 34033 - DNA, 174 bp, synthetic construct
  source 1..174: mol_type = other DNA
tatttccctctactgagtaaaccctatctgtgattcccccaaacatctggcatggctcccttttgtccttcctgtgccctgcaaatattagcaaagaagcttcatgccaggttaggaaggcagcattccatgaccagaaacagggacaaagaaatccccccttcagaacagagg

SEQ ID NO: 34034 - DNA, 174 bp, synthetic construct
  source 1..174: mol_type = other DNA
tgttacttaagaatgctttccaggtggaaagttccttaagtttgaggcttcaaattccatacagcacattaaaatcccattcatgagtttgaaatactgctctgttgtcttggaaataccaatcagattgttggctgaagtgatgtggataaagaagggatcttagaaaaacta

SEQ ID NO: 34035 - DNA, 174 bp, synthetic construct
  source 1..174: mol_type = other DNA
acgaagttccggaaatggaattaccgagtcagatgagaaacacaagtcatcaatgaattaacaagcaacacattgtcacatccagctgttgaagagtggttaactcagcttgatctccgaagactcttctgcaccccaccccgcccccaactgctttccaaagagaaacagaaa

SEQ ID NO: 34036 - protein, 4 aa, synthetic construct
DEAD

SEQ ID NO: 34037 - protein, 4 aa, synthetic construct
DEAH

SEQ ID NO: 34038-34039 - skipped (2 entries)
